United States Patent 9,920,329 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 4

SEQ ID NO: 6371 - protein, 427 aa, Gossypium hirsutum
MDPTSRPAVVIDNGTGFTKMGFAGNVEPCFIQPTVVAVNESLLNQSRASSKSNWLAQYSAGVMADLDFFIGDEALTRSRSSNNYNITHPIKHGQVDNWDAMERYWQQCIFNYLRCDPEDHYFLLTESPLTAPENREYMGEIMFETFNVPGLYIAVNSVLALAAGYTTSKCEMTGVVVDVGDGATHIVPVADGYVIGSSIKSIPIAGKDVTLFIQQLMRERGEKVPPEDSFEVARKVKERYCYTCSDIVKEFNKHDKEPSKYIKQWRGIRPKTGTPYSCDIGYERFLGPEVLFNPEIHNSNFTTPLPAVIDKCIQSAPIDTRRALYKNIVLSGGSTMFKDFHRRLQRDLKKIVDARVLASDSRYGGEVKAQPVEVNVVSHPIQGFAVWFGGSVLASTPEFYAASHTKAEYEEHGASICRTNPVFKGMY

SEQ ID NO: 6372 - protein, 431 aa, Lactuca sativa
MDPSTSRPAVVIDNGTGYTKMGFAGNVEPCFIAPTVVAVNESFITQPNRSSTKGSSSWLTQHSAGVMADLDFFIGEEAISKSRSSSTYSLTYPIKHGQVENWDAMERFWQQCIFNYLRCDPEDHYFLLTESPLTPPESREYTGEIMFETFNVPGLYIAVQPVLALAAGYTSSKCEMTGVVVDVGDGATHVVPVAEGYVIGSSIKSLPISGKDVTLFVQQLMRERGEHVPPEDSLEVARKIKETYCYTCADIVKEYNKHDKEPSKYVKQWRGIKPKTGAPYSCDVGYERFLGPEIFFNPEIYDKDFTTPLPAVIDRCIQSAPIDTRRALYKNIVLSGGSTMFKDFQRRLQRDTKKIVDARVLASSARHGSEVKAQPVEVNVVSHPIQRYAVWFGGSVLASTPEFFTACHTKAEYEEYGASICRTNPVFKGMY

SEQ ID NO: 6373 - protein, 373 aa, Cephalotaxus harringtonia
MDATSRPAVVIDNGTGYTKMGFAGNVEPCFIIPTVVAVNESFLSQSRGSGKGSWLAQHNAGVMADLDFFIGDEALSRSHSSNTYNLSYPIRHGQVENWDTMERFWQQCIFNYLRCDPEDHYFLLTESPLTAPENREYTGEIMFETFNVPGLYIAVQAVLALAAGYTTSKCEMTGVVVDAGDGATHVVPVADGYVIGSSIKSIPIAGKDLTLFVQQLMRERGENIPPEDSLEVARKVKGTYCYTCSDIVKEFGKHDREPSKYIKQWTGKKPKTGAPYSCDVGYERFMAPEVFFHPEIYSSDYTTPLPVVVDRCIQSSPIDTRRALYKNIVLSGGSTMFKDFQRRLQRDIKKLWILELLHQMLGLVVNQNHKQWK

SEQ ID NO: 6374 - protein, 427 aa, Pinus taeda
MDATSRPAVVIDNGTGYTKMGFAGNVEPCFIIPTVVAVNESFLSQSRGSGKGNWLAQHDAAVKADLDFFIGEEALSRSHSSNTYNLSYPIRHGQVENWDSMERYWQQCIFNYLRCDPEDHYFLLTESPLTAPENREYTGEIMFETFNVPGLYIAVQAVLAIAAGYTTSKCEMTGVVVDAGDGITHIVPVADGYVIGSAIKSIPIAGRDLTLFVQQLMRERGENIPPEDSFEVARRIKEAYCYTCADIVKEFGKHDRDPEKYIKQWSGTKPKTGARYSCDVGYERFLAPEVFFNPEIYSSDYTTPLPVVVDKCIQSSPIDTRRALYKNIVLSGGSTMFKDFPRRLQRDIKKIVDARIGASDARLGGEVKSQAVDVNVVGHPIQRFAVWFGGSVLASTPEFYTACHTKAEYEEYGPSICRTNPVFKGMY

SEQ ID NO: 6375 - protein, 427 aa, Eutrema halophilum
MDPTSRPAVVIDNGTGYTKMGFAGNVEPCFILPTVVAVNESFLNQSKSSLKGNWTVQHNAGVAADLDFFIGDEALTKSRSSSTYNLHYPIEHGQVEDWDAMERYWQQCIFNYLRCDPEDHYFLLTESPLTPPESREYTGEILFETFNVPGLYIAVNSVLALAAGYTTSKCEMTGVVVDVGDGATHVVPVAEGYVIGSCIKSIPIAGKDVTLFIQQLMRERGENIPPEDSFDVARKVKEMYCYTCSDIVKEFNKHDKEPGKFIKQWKGVKPKTGAPYTCDVGYERFLGPEVFFNPEIYSNDFTTALPAVIDKCIQSAPIDTRRALYKNIVLSGGSTMFKDFGRRLQRDLKKIVDARVLANNARTGGEITSQPVEVNVVSHPVQRFAVWFGGSVLSSTPEFFASCRTKEEYEECGASICRTNPVFKGMY

SEQ ID NO: 6376 - protein, 431 aa, Lactuca sativa
MDPSTSRPAVVIDNGTGYTKMGFAGNVEPFFNVPTVVALNDSFVSQPSRSSIKGSSSWLNQHSAGVMADLDFHIGEEAMSKSRSSGIYNLTHPIKHGQVENWDAMERFWQQCIYNYLRCDPEDHYFLLTESPLTAPETREYTGEIMFETFNVPGLYIAVQPVLALAAGYTTKKCEMTGVVVDVGDGATHVVPVAEGYVIGSSIKSIPISGKDVTYFIQQLMRERGEHIPPEDSLEVARKVKETFCYTCSDIVKEFNKHDKEPAKYIKQWKGIKPKTGAPYSCDIGYERFLGPEVFFNPEIYNRGFTTPLPVVIDKCIQSAPIDTRRALYKNIVLSGGSTMFKDFHRRLQREVKKIVGARVHASEAKFSNEVKAQPVEVNVVSHPIQKHAVWFGGSVLASTQEFFMACHTKAEYEEYGASICRTNPVFKGMY

SEQ ID NO: 6377 - protein, 427 aa, Pinus pinaster
MDATSRPAVVIDNGTGYTKMGFAGNVEPCFIIPTVVAVNESFVSQSRGSGKGNWLAQHDAAVKADLDFYIGEEALSRSHSSNTYNLSYPIRHGQVENWDSMERYWQQCIFNYLRCDPEDHYFLLTESPLTAPENREYTGEIMFETFNVPGLYIAVQAVLAIAAGYTTSKCEMTGVVVDAGDGITHIVPVADGYVIGSAIKSIPIAGRDLTLFVQQLMRERGENIPPEDSLEVARRIKEAYCYTCADIVKEFGKHDRDPEKYIKQWSGTKPKTGARYSCDVGYERFLAPEVFFNPEIYSSDYTTPLPVVVDKCIQSSPIDTRRALYKNIVLSGGSTMFKDFPRRLQRDIKKIVDARIGASDARLGGEVKSQAVDVNVVGHPIQRFAVWFGGSVLASTPEFYTACHTKAEYEEYGPSICRTNPVFKGMY

SEQ ID NO: 6378 - protein, 428 aa, Cajanus cajan
MDPSMSRPAVVIDNGSGYTKMGFAGNVEPCFILPTVVAVNESFLNQSRSTSKGNWVTQHNAGVIADLDFFIGDEALAKYRTSSTYNLNYPIQQGQIENWDAMERFWQQCIFNYLRCDPEDHYFLLTESPLTAPESREYTGEIMFETFNVPGLYIAVNSVLALAAGYTTSKCEMTGVVVDIGDGAAHVVPVADGYVIGSSIKSIPISGKDATLFVQQLMRERGENIPPEDSFEVARKVKEMHCYTCSDIVKEFNKHDKEPAKYVKQWKGIKPKTGAPYSCDIGYERFLGPEIFFNPEIYSSDFTTPLPVIIDKCIQSAPIDTRRSLYKNIVLSGGSTMFKDFHRRMQRDIRKIVDARVLSSEARLNGEIKSQPVEVNVVSHPIQRFAVWFGGSVLASTPEFFASCHTKEEYDEYGASICRTNPVFKGMY

SEQ ID NO: 6379 - protein, 427 aa, Arabidopsis thaliana
MDPTSRPAIVIDNGTGYTKMGFAGNVEPCFILPTVVAVNESFLNQSKSSSKATWQTQHNAGVAADLDFYIGDEALAKSRSSSTHNLHYPIEHGQVEDWDAMERYWQQCIFNYLRCDPEDHYFLLTESPLTPPESREYTGEILFETFNVPGLYIAVNSVLALAAGYTTSKCEMTGVVVDVGDGATHVVPVAEGYVIGSCIKSIPIAGKDVTLFIQQLMRERGENIPPEDSFDVARKVKEMYCYTCSDIVKEFNKHDKEPAKYIKQWKGVKPKTGAPYTCDVGYERFLGPEVFFNPEIYSNDFTTTLPAVIDKCIQSAPIDTRRALYKNIVLSGGSTMFKDFGRRLQRDLKKIVDARVLANNARTGGEITSQPVEVNVVSHPVQRFAVWFGGSVLSSTPEFFASCRTKEEYEEYGASICRTNPVFKGMY

SEQ ID NO: 6380 - protein, 434 aa, Centaurea maculosa
  misc_feature (8)..(8): Xaa can be any naturally occurring amino acid
  misc_feature (19)..(19): Xaa can be any naturally occurring amino acid
  misc_feature (184)..(184): Xaa can be any naturally occurring amino acid
  misc_feature (187)..(187): Xaa can be any naturally occurring amino acid
  misc_feature (221)..(221): Xaa can be any naturally occurring amino acid
  misc_feature (292)..(292): Xaa can be any naturally occurring amino acid
MDPSTSRXAVVIDNGTGYXKMGFAGNVEPCFIAPTVVAVNESFITQPNRSSNKGSSSWMAQHSAGVMADLDFFIGEEALSKSRTSSTYNLTYPIKHGQVENWDAMERFWQQCIFNYLRCDPEDHYFLLTESPLTPPESREYTGEIMFETFNVPGLYIAVQPVLALAAGYTTSKCEMTGVVVDVXDGXTHVVPVAEGYVIGSSIKSIPISGRDVTLFVQQLXRERGEHVPPEDSFEIARKVKETYCYTCADIVKEYNKHDKEPSKYIKQWRGIKPKTGAPYACDVGYERFLGXEIFFNPEIYNKDFTTPLPAVIDKCIQSAPIDTRRALYKNIVLSGGSTMFKDFQRRLQRDTKKIVDARVLASNMKYTSTSNEVKSQPVEVNVVSHPIQRYAVWFGGSVLASTPEFFTAYHTKAEYEEYGASICRTNPVFKGMY

SEQ ID NO: 6381 - protein, 427 aa, Picea glauca
MDATSRPAVVIDNGTGYTKMGFAGNVEPCFIIPTVVAVNESFVSQSRGSGKGSWLAQHDAAVKADLDFFIGEEALSRSHSSNTYNLSYPIRHGQVENWDTMERYWQQCIFNYLRCDPEDHYFLLTESPLTAPENREYTGEIMFETFNVPGLYIAVQAVLAIAAGYTTSKCEMTGVVVDAGDGITHIVPVADGYVIGSAIKSIPIAGRDLTLFVQQLMRERGENIPPEDSLEVARRIKEAYCYTCADIVKEFGKHDRDPEKYIKQWTGTKPKTGARYSCDVGYERFLAPEVFFNPEIYSSDYTTPLPVVVDKCIQSSPIDTRRALYKNIVLSGGSTMFKDFPRRLQRDIKKIVDARIGASDARLGGEVKSQAVDVNVVGHPIQRFAVWFGGSVLASTPEFYTACHTKEEYEEYGPSICRTNPVFKGMY

SEQ ID NO: 6382 - protein, 427 aa, Arabidopsis lyrata
MDPTSRPAVVIDNGTGYTKMGFAGNVEPCFILPTVVAVNESFLNQSKSSSKATWQTQHNAGVAADLDFYIGDEALAKSRSSSTHNLHYPIEHGQVEDWDAMERYWQQCIFNYLRCDPEDHYFLLTESPLTPPESREYTGEILFETFNVPGLYIAVNSVLALAAGYTTSKCEMTGVVVDVGDGATHVVPVAEGYVIGSCIKSIPIAGKDVTLFIQQLMRERGENIPPEDSFDVARKVKEMYCYTCSDIVKEFNKHDKEPAKYIKQWKGVKPKTGAPYTCDVGYERFLGPEVFFNPEIYSNDFTTTLPAVIDKCIQSAPIDTRRALYKNIVLSGGSTMFKDFGRRLQRDLKKIVDARVLANNVRTGGEITSQPVEVNVVSHPVQRFAVWFGGSVLSSTPEFFASCRTKEEYEEYGAGICRTNPVFKGMY

SEQ ID NO: 6383 - protein, 427 aa, Eutrema parvulum
MDPTSRPAVVIDNGTGYTKMGFAGNVEPCFILPTVVAANESFLSQPKSSLKGTWAAQHNAGVAADMDFFIGDEALTKSRSSSTYNLHYPIEHGQVEDWDAMERYWQQCVFNYLRCDPEDHYFLLTESPLTPPESREYTGEILFETFNVPGLYIAVNSVLALAAGYTTSKCEMTGVVVDVGDGATHVVPVAEGYVIGSCIKSIPIAGKDVTLFIQQLMRERGENIPPEDSFDVARKVKEMYCYTCSDIVKEFNKHDKEPGKFIKQWKGVKPKTGAPYTCDVGYERFLGPEVFFNPEIYSNDFTTSLPAVIDKCIQSAPIDTRRALYKNIVLSGGSTMFKDFGRRLQRDLKKIVDARVLANNARTGGEITSQPVEVNVVSHPVQRFAVWFGGSVLSSTPEFFASCRTKEEYEECGASICRTNPVFKGMY

SEQ ID NO: 6384 - protein, 80 aa, Pseudotsuga menziesii
MDATSRPAVVIDNGTGYTKMGFAGNVEPCFIIPTVVAVNESFVSQSRGSGKGSWLAQHDAAVKADLDFFSWGRGFVSFSF

SEQ ID NO: 6385 - protein, 510 aa, Theobroma cacao
MDPTSRPAVVIDNGTGYGLSSIIVTEIVVAHNLYTKMGFAGNVEPCFIQPTVVAVNESFLNQSRSSSKANWLAQYSAGVMADLDFFIGDEALARSRASNTYNLTYPIRHGQVDNWDAMERYWQQCIFNYLRCDPEDHYFLLTESPLTAPESREYTGEIMFETFNVPGLYIAVNSVLALAAGYTTSKCEMTGVVVDVGDGATHVVPVADGYVIGSSIKSIPIAGKDVTLFIQQLMRERGEKIPPEDSFEAARKVKEMYCYTCSDIVKEFNKHDKEPAKYIKQWRGIRPKTGAPYSCDIGYERFLGPEVFFSPEIYSSDFTTPLPAVIDKCIQSAPIDTRRALYKNIVLSGGSTMFKDFHRRLQRDLKKIVDARVLASDARLGGEVKAQPVEVNVVSHPIQRFAVWFGGSVLASTPEFFAACHTKAEYEEYGASICRTNPWVTWYFHFHHEHQFSSLVPSVLGGKGRPHSSPENAVKFVASRLCQHLMEQMEYQIVGKKSAELNCIFSVQLT

SEQ ID NO: 6386 - protein, 427 aa, Unknown
  Sequence found in Organisms: Brassica napus, Brassica rapa
MDPTSRPAVVIDNGTGYTKMGFAGNVEPCFILPTVVASNESFLSQPKSSLKGSWAAQHNAGVAADMDFFIGDEALTKSRSSSTYNLRYPIEHGQVEDWDAMERYWQQCVFNYLRCDPEDHYFLLTESPLTPPESREYTGEILFETFNVPGLYIAVNSVLALAAGYTTSKCEMTGVVVDVGDGATRVVPVAEGYVIGSCIKTIPIAGKDVSLFIQQLMRERGENIPPEDSFDVARKVKEMYCYTCSDIVKEFNKHDKEPGKYIKQWKGVKPKTGAPYTCDVGYERFLGPEVFFNPEIYSNDFTTSLPTVIDKCIQSAPIDTRRALYKNIVLSGGSTMFKDFGRRLQRDLKKIVDARVLANNARTGGEITSQPVEVNVVSHPVQKFAVWFGGSVLSSTPEFFASCRTKEEYEECGASICRTNPVFKGMY

SEQ ID NO: 6387 - protein, 427 aa, Brassica napus
MDPTSRPAVVIDNGTGYTKMGFTGNVEPCFILPTVVASNESFLSQPKSSLKGSWAAQHNAGVAADMDFFIGDEALTKSRSSSTYNLRYPIEHGQVEDWDAMERYWQQCVFNYLRCDPEDHYFLLTESPLTPPESREYTGEILFETFNVPGLYIAVNSVLALAAGYTTSKCEMTGVVVDVGDGATRVVPVAEGYVIGSCIRTIPIAGKDVSLFIQQLMRERGENIPPEDSFDVARKVKEMYCYTCSDIVKEFNKHDKEPGKYIKQWKGVKPKTGAPYTCDVGYERFLGPEVFFNPEIYSNDFTTSLPAVIDKCIQSAPIDTRRALYKNIVLSGGSTMFKDFGRRLQRDLKKIVDARVLANNARTGGEITSQPVEVNVVSHPVQKFAVWFGGSVLSSTPEFFASCRTKEEYEECGASICRTNPVFKGMY

SEQ ID NO: 6388 - protein, 427 aa, Brassica napus
MDPTSRPAVVIDNGTGYTKMGFAGNVEPCFILPTVVAANESFLSQPKSSLKGSWAAQHNAGVAADMDFFIGDEALAKSRSSSTYNLRYPIEHGQVEDWDAMERYWQQCVFNYLRCDPEDHYFLLTESPLTPPESREYTGEILFETFNVPGLYIAVNSVLALAAGYTTSKCEMTGVVVDVGDGATRVVPVAEGYVIASCIKSIPIAGKDVTLFIQQLMRERGENIPPEDSFDVARKVKEMYCYTCSDIVKEYNKHDKEPGKYIKQWKGVKPKTGAPYTCDVGYERFLGPEVFFNPEIYSNDFITSLPAVIDKCIQSAPIDTRRALYKNIVLSGGSTMFKDFGRRLQRDLKKIVDARVLANNARTGGEITSQPVEVNVVSHPVQKFAVWFGGSVLSSTPEFFASCRTKEEYEECGASICRTNPVFKGMY

SEQ ID NO: 6389 - protein, 415 aa, Medicago truncatula
MAPGIQKWALLVMLNLVLLFRVWLLINESFLNQSRSSSKGNWIAQHNAGVMADLDFFIGDDALSKSRSSSTYNLTYPIKHGQVENWDAMERFWQHCIFNYLRCDPEDHYFLLTDSPLTAPESREYTGEIMFETFNVPGLYIAVNSVLALAAGYTTSKCEMTGVVVDIGDGATHVVPVADGYVIGSSIKSVPIAGKDVTLFVQQLMRERGENIPPEDSFEVARKVKEMHCYTCSDIVKEYNKHDKEPAKYIKQWRGVKPKTGAPYSCDIGYERFLGPEVFFNPEIYSSDFTTPLPVVIDKCIQSAPIDTRRSLYKNIVLSGGSTMFKDFHRRLQRDIKKIVDARVLAAEARLNGEIKSHPVEVNVLSHPIQRFAVWFGGSVLASTPEFFTACHTKAEYEEYGASICRTNPVFKGMY

SEQ ID NO: 6390 - protein, 427 aa, Brassica rapa
MDPTSRPAVVIDNGTGYTKMGFAGNVEPCFILPSVVAANESFLSQPKSSLKGTWAAQHNAGVAADMDFFIGDEALAKSRSSSTYNLRYPIEHGQVEDWDAMERYWQQCVFNYLRCDPEDHYFLLTESPLTPPESREYTGEILFETFNVPGLYIAVNSVLALAAGYTTSKCEMTGVVVDVGDGATRVVPVAEGYVIASCIKSIPIAGKDVTLFIQQLMRERGENIPPEDSFDVARKVKEMYCYTCSDIVKEYNKHDKEPGKYIKQWKGVKPKTGAPYTCDVGYERFLGPEVFFNPEIYSNDFITSLPAVIDKCIQSAPIDTRRALYKNIVLSGGSTMFKDFGRRLQRDLKKIVDARVLANNARTGGEITSQPVEVNVVSHPVQKFAVWFGGSVLSSTPEFFASCRTKEEYEECGASICRTNPVFKGMY

SEQ ID NO: 6391 - protein, 110 aa, Saccharum officinarum
MRPLLVLALIFVIAGVAHGAGECGRASADRVALRLAPCVSAADDPQSTPTSSCCSAVHAIGQSPSCLCAVMLSGTARAAGIKPEVAITIPKRCNMADRPVGYKCGDYTLP

SEQ ID NO: 6392 - protein, 111 aa, Zea mays
MARQLVVLALLFVIAGVAHGAGECGRASADRVALRMAPCISAADDPQSTPTSSCCSAVHTIGQSPSCLCAVMLSGTARAAGIKPEVAITIPKRCNMADRPVGYKCGDYTLP

SEQ ID NO: 6393 - protein, 115 aa, Panicum virgatum
MRPLVVLGLVLVLAAGVALDGVDGAGECGRASADRVALRLAPCVSAADDPQSTPTSSCCSAVHTIGQSPSCLCAVMLSGTARAAGIKPEVAITIPKRCNMADRPVGYKCGDYTLP

SEQ ID NO: 6394 - protein, 114 aa, Setaria italica
MRPLVVLGLVLVVAGVALEGAAAAGECGRASADRVALRLAPCISAADDPQSTPTSSCCSAVHTIGQSPSCLCAVMLSRTASAAGIKPEVAITIPKRCNMADRPVGYKCGDYTLP

SEQ ID NO: 6395 - protein, 140 aa, Panicum virgatum
MRPLVVLGLVLVVAAGVALDGADGAGECGRASADRVALRLAPCISAADDPQSTPTSSCCSAVHAIGQSPSCLCAVMLSGTARAAGIKPEVAITIPKRCNMADRPVGYKCETTRCPDDLVREAAALVIMKEMDAKEGFVLE

SEQ ID NO: 6396 - protein, 342 aa, Pennisetum glaucum
KNYLQDQLLGFALVPLPEVVSADGGTLAREFPLTTSDLFQTPSGFLQLELSYIGVVPEVVPISPTPKPALADPEEEPESNAGAGAGNGKEYEKIEFPDLNLVEENQIMVSEYTGLPCAAVEAQSSESLLTSDHEDGATTMSHEAGVRLVESFSTDHSTADADSVGGFRSDDTPVSSVSTTESPGAAAVPATPQSNSSSEPSGNAHSSAEAKEKAAPEATDAEVDSSRTVQESPAANSPGAASEAAVDKPVITVNIEQEVKVDGNQIMDMYMKSMQQFTDSLAKMKLPALDLDNGSSEKSSPATAASEVDSSGAVSSAAKKPAAGGQQEKPSPKVFYGSRAFF

SEQ ID NO: 6397 - protein, 114 aa, Cynodon dactylon
MRSLVVLALFALLAGIALEVADGAGECGRASADRVALRLAPCISAADDPQSTPTSSCCAAVHTIGQSPSCLCAVMLSGTARAGGIKPEAAITIPKRCNMADRPIGYKCGEYTLP

SEQ ID NO: 6398 - protein, 114 aa, Eragrostis curvula
MRSFVVVALVLAIAGVALRGADAAGECGRASADRMALRLAPCISAADDPQSTPSSSCCSAVHTIGQSPSCLCAVMLSGTAKAAGIKPEVAITIPQRCNVADRPVGYKCGDYTLP

SEQ ID NO: 6399 - protein, 117 aa, Oryza sativa
MRAGRLVILVAVAVVVVVAGGGAAEGAGECGRASADRVALRLAPCVSAADDPQSAPSSSCCSAVHTIGQSPSCLCAVMLSNTARVAGIKPEVAITIPKRCNMADRPVGYKCGDYTLP

SEQ ID NO: 6400 - protein, 112 aa, Hordeum vulgare
MRPLVVLALAVALAGVALGEGAGECGRSSPDRMALRMAPCISAADEPDSAPSSSCCSAVHTIGKSPSCLCAVMLSGTAKMAGIKPEVAITIPKRCNMADRPVGYKCGDYTLP

SEQ ID NO: 6401 - protein, 152 aa, Unknown
  Sequence found in Organisms: Pennisetum glaucum, Cenchrus ciliaris
MSLIAGEDFQHILRLLNTNVDGKQKIMFALTSIKGVGRRFSNIVCKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6402 - protein, 152 aa, Unknown
  Sequence found in Organisms: Zea mays, Triticum aestivum
MSLIAGEDFQHILRLLNTNVDGKQKIMFAMTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6403 - protein, 152 aa, Unknown
  Sequence found in Organisms: Setaria italica, Panicum virgatum
MSLIAGEDFQHILRLLNTNVDGKQKIMFALTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6404 - protein, 152 aa, Eragrostis curvula
MSLVAGEDFQHILRLLNTNVDGKQKIMFAMTSIKGIGRRFSNIVCKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6405 - protein, 152 aa, Oryza sativa
MSLIAGEDFQHILRLLNTNVDGKQKIMFALTSIKGVGRRFSNIACKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6406 - protein, 152 aa, Saccharum officinarum
MSLIAGEDFQHILRLLNTNVDGKQKIMFAMTSIKGIGRRFSNIVCKKADIDMNKRAGELTSEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6407 - protein, 152 aa, Panicum virgatum
MSLIAGEDFQHILRLLNTNVDGKQKIMFAMTSIKGIGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6408 - protein, 152 aa, Unknown
  Sequence found in Organisms: Setaria italica, Panicum virgatum
MSLIAGEDFQHILRLLNTNVDGKQKIMFALTSIKGVGRRFSNIVCKKADIDMNKRAGELSPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6409 - protein, 152 aa, Sorghum bicolor
MSLIAGEDFQHILRLLNTNVDGKQKIMFAMTSIKGVGRRFSNIVCKKADIDMNKRAGELSSDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6410 - protein, 152 aa, Saccharum officinarum
MSLIAGEDFQHILRLLNTNVDGKQKIMFAMTSIKGVGRRFSNIVCKKADIDMNKRAGELSADELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6411 - protein, 152 aa, Brachypodium distachyon
MSLIAGEEFQHILRLLNTNVDGKQKIMFALTSIKGVGRRFSNIVCKKADIDMNKRAGELTPEELDRLMHVVANPRQFKVPDWFLNRKKDYKDGRFSQVVSNALDMKLRDDLERLKKIRNHRGLRHYWGVRVRGQHTKTTGRRGKTVGVSKKR

SEQ ID NO: 6412 - protein, 151 aa, Oryza sativa
LSFPRGYFQHILRLLNTNVDGKQKIMFALTSIKGVGRRFSNIACKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6413 - protein, 148 aa, Oryza sativa
MGEDFQHILRLLNTNVDGKQKIMFALTSIKGIGRRFSNIACKKADIDMNKRAGELTPEELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6414 - protein, 158 aa, Panicum virgatum
GGVGLLQSLIAGEDFQHILRLLNTNVDGKQKIMFALTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6415 - protein, 152 aa, Brachypodium distachyon
MALIAGEEFQHILRLLNTNVDGKQKIMFALTSIKGIGRRYSNIVCKKADIDMNKRAGELTTEELDRLMVVVSNPRQFKVPDWFLNRKKDYKDGRFSQVVSNALDMKLRDDLERLKKIRNHRGLRHYWGVRVRGQHTKTTGRRGKTVGVSKKR

SEQ ID NO: 6416 - protein, 152 aa, Hordeum vulgare
MSLIAGEEFQHILRVLNTNVDGKQKIMFALTSIKGVGRRFSNIACKKADIDMNKRAGELSSEEMDRLMTVVANPRQFKVPDWFLNRKKDYKDGRFTQVVSNAVDMKLRDDLERLKKIRNHRGLRHYWGVRVRGQHTKTTGRRGKTVGVSKKR

SEQ ID NO: 6417 - protein, 152 aa, Pseudoroegneria spicata
MSLIAGEEFQHILRVLNTNVDGKQKIMFALTSIKGVGRRFSNIVCKKADIDMNKRAGELSSEEMDRLMAVVANPRQFKVPDWFLNRKKDYKDGRFSQVVSNNVDMKLRDDLERLKKIRNHRGLRHYWGVRVRGQHTKTTGRRGKTVGVSKKR

SEQ ID NO: 6418 - protein, 152 aa, Unknown
  Sequence found in Organisms: Secale cereale, Triticum aestivum
MSLIAGEEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 6419 - protein, 91 aa, Eragrostis curvula
  misc_feature (77)..(77): Xaa can be any naturally occurring amino acid
MSLVAGGDFQHILRLLNTNVDGKQKIMFAMTSIKGIGRRFSNIVCKKADIDMNKRAGELTPEDLSAHDVVATPSVQXSGLVPEQEEGLQGW

SEQ ID NO: 6420 - protein, 103 aa, Secale cereale
MSLIAGEEFQHILRVLNTNVDGKQKIMFALTSIKGVGRRFSNIVCKKADIDMNKRAGELSAEEMDRLMAVVHNPRQFKVARLVPQQEEGLQGRQVLPGRLQRR

SEQ ID NO: 6421 - protein, 109 aa, Secale cereale
MSLIAGEEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLEG

SEQ ID NO: 6422 - protein, 103 aa, Secale cereale
MSLIAGEEFQHILRVLNTNVDGKQKIMFALTSIEGCGPPLLQHRLQEGRHRHEQEGWRAFRGGDGPSDGGGAQPAPVQGAGLVPQQEEGLQGREVLPGRLQRR

SEQ ID NO: 6423 - protein, 76 aa, Secale cereale
NPRRSNAANLLPLAPPPPPTTPTAAMSLIAGEEFQHILRVLNTNVDGKQKIMFALTSIKGWAAASPTSSARRPTST

SEQ ID NO: 6424 - protein, 152 aa, Avena sativa
MSLIAGEEFQHILRVLNTNVDGKQKIMFALTSIKGIGRRFSNIACKKADIDMNKRAGELTTEEMDRLMTVVQNPRQFKVPDWFLNRKKDYKDGRFSQVVSNQVDMKLRDDLERLKKIRNHRGLRHYWGVRVRGQHTKTTGRRGKTVGVSKKR

SEQ ID NO: 6425 - protein, 152 aa, Elaeis guineensis
MSLIANEDFQHILRVLNTNVDGKQKIMFALTSIKGIGRRFANIVCKKADVDMNKRAGELSAAELENLMTVVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6426 - protein, 152 aa, Secale cereale
MSLIAGDEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 6427 - protein, 60 aa, Zea mays
MSLIAGEDFQHILRLLNTNVDGKQKIMFALTSIKGVGHHFSNIVCKKANIDMNKQAGELS

SEQ ID NO: 6428 - protein, 152 aa, Festuca arundinacea
MSLIAGEEFQHILRLLNTNVDGKQKIMFALTSIKGVGRRFSNIICKKADIDMDKRAGELTTEEMDRVMTVLQNPRQFKVPDWFLNRKKDYKDGKFSQVVSNQLDMKLRDDLERLKKIRNHRGLRHYWGVRVRGQHTKTTGRRGKTVGVSKKR

SEQ ID NO: 6429 - protein, 152 aa, Zingiber officinale
MSLVANEDFQHILRVLNTNVDGKQKIMFALTSIKGIGRRFANIVCKKADVDMNKRAGELSAAELENLMTVVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6430 - protein, 152 aa, Elaeis guineensis
MSLIANEDFQHILRVLNTNVDGKQKIMIALTSIKGIGRRFANIVCKKADVDMNKRAGELSAAELENLMTVVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6431 - protein, 152 aa, Phalaenopsis aphrodite
MSLIANEDFQHILRVLNTNVDGKKKIMFALTSIKGIGRRFANIVCKKADVDMNKRAGELTAAELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6432 - protein, 152 aa, Phalaenopsis aphrodite
MSLIANEDFQHILRVLNTNVDGKKKIMFALTSIKGIGRRFANIVCKKADVDMNKRAGELSAAELENLMTVVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6433 - protein, 152 aa, Ananas comosus
MSLIANEDFQHILRVLNTNVDGKQKIMFALTSIKGVGRRFTNIVCKKADVDMNKRAGEISAMELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6434 - protein, 152 aa, Papaver somniferum
MSLVANEDFQHILRVLNTNVDGKQKIMFAMTSIKGIGRRFANIVCKKADVDMNKRAGELSVAELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6435 - protein, 152 aa, Papaver somniferum
MSLVANEDFQHILRVLNTNVDGKQKIMFAMTSIKGIGRRFANIVCKKADVDMNKRAGELSAAELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6436 - protein, 152 aa, Vigna unguiculata
MSVVANEDFQHILRVLNTNVDGKQKIMFALTSIKGIGRRFANIVCKKADVDMNKRAGELTAAELDNLMTVVANPRQFKVPDWFLNRKKDYKDGKYSQVVSNALDMKLRDDLERLKKIRNHRGLRHYWGLRVRGQHTKTTGRRGKTVGVSKKR

SEQ ID NO: 6437 - protein, 152 aa, Ipomoea nil
MSLVANEDFQHILRILNTNVDGKQKIMFAMTSIKGIGRRFANICCKKADIDMNKRAGELTAAEIDNLMTVVANPRQFKVPDWFLNRQKDYKDGNYSQVVSNALDMKLRDDLERLKKIRNHRGLRHYWGLRVRGQHTKTTGRRGKTVGVSKKR

SEQ ID NO: 6438 - protein, 152 aa, Unknown
  Sequence found in Organisms: Liriodendron tulipifera, Platanus occidentalis
MSLIANEDFQHILRVLNTNVDGKQKIMFALTSIKGIGRRFANIVCKKADVDMNKRAGELSAAELENLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6439 - protein, 152 aa, Avena sativa
MSLISGEEFQHILRLLNTNVDGKQKIMFALTSIKGIGRRYSNIVCKKADIDMNKRAGELTTEELDRVMTVVQNPRLFKVPDWFLNRKKDYKDGRYSQVVSNGVDMKLRDDLERLKKIRNHRGLRHYWGVRVRGQHTKTTGRRGKTVGVSKKR

SEQ ID NO: 6440 - protein, 152 aa, Arachis hypogaea
MSLVANEDFQHILRVLNTNVDGKQKIMFAMTSIKGIGRRFANICCKKADIDMNKRAGELSAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6441 - protein, 152 aa, Platanus occidentalis
MSLIANEDFQHILRVLNTNVDGKQKIMFALTSIKGIGRRFANIVCKKADVDMNKRAGELSAQELENLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6442 - protein, 152 aa, Papaver somniferum
MSLVANEDFQHILRVLNTNVDGKQKIMFAMTSIKGIGRRFANIVCKKADVDMSKRAGELSAAELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6443 - protein, 126 aa, Phalaenopsis aphrodite
MFALTSIKGIGRRFANIVCKKADVDMNKRAGELTAAELENLMTIVANPRQFKIPDWLLNRKKDYKDGRYSQVVSNALDMKLRDDLERLKKIRNHRGLRHYWGLRVRGQHTKTTGRRGKTVGVSKKR

SEQ ID NO: 6444 - protein, 122 aa, Papaver somniferum
MSLVANEDFQHILRVLNTNVDGKQKIMFAMTSIKGIGRRFANIVCKKADVDMNKRAGELSAAELENLMTIVANPRQFKIPDWFLNRKKDYKDGRYSQVVSNALDMKLRDDLERLKKIRTIMV

SEQ ID NO: 6445 - protein, 152 aa, Acacia harpophylla
MSLVANEDFQHILRVLNTNVDGKQRIMFAMTSIKGIGRRFANICCKKADIDMNKRAGELSAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6446 - protein, 152 aa, Amorphophallus konjac
MSLIANEDFQHILRLMNTNVDGKRKIMFALTAIKGIGRRFANIVCKKADVDMNKRAGELSAAELENLMTVIANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6447 - protein, 152 aa, Unknown
  Sequence found in Organisms: Aristolochia fimbriata, Chelidonium majus, Eschscholzia californica
MSLVANEDFQHILRVLNTNVDGKQKIMFALTSIKGIGRRFANIVCKKADVDMNKRAGELSAAELENLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6448 - protein, 152 aa, Persea americana
MSLIANEEFQHILRVLNTNVDGKQKIMFALTSIKGIGRRFANLVCKKADVDMNKRAGELSAAELESLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6449 - protein, 152 aa, Beta vulgaris
MSLVANEEFQHILRLLNTNVDGKQKIMFAMTSIKGIGRRYANICCKKADIDMNKRAGELTAAELDNLMTVVANPRQFKIPDWFLNRQKDYKDGRFSQVLSNQLDMKLRDDLERLKKIRNHRGLRHYWGLRVRGQHTKTTGRRGKTVGVSKKR

SEQ ID NO: 6450 - protein, 152 aa, Beta vulgaris
MSLVANEEFQHILRLLNTNVDGKQKIMFAMTSIKGIGRRYANICCKKADIDMNKRAGELTAAELDNLMTVVANPRQFKVPDWFLNRQKDYKDGRYSQVLSNQLDMKLRDDLERLKKIRNHRGLRHYWGLRVRGQHTKTTGRRGKTVGVSKKR

SEQ ID NO: 6451 - protein, 152 aa, Curcuma longa
MSLVAKEDFQHILRVLNTNVDGKQKIMFALTSIKGIGRRFANIVCKKAEVDMNKRAGELSAAELENLMTVVGNPRQFKIPDWFLNRKKDYKDGRYSQVVSNALDMKLRDDLERLKKIRNHRGLRHYWGLRVRGQHTKTTGRRGKTVGVSKKR

SEQ ID NO: 6452 - protein, 152 aa, Unknown
  Sequence found in Organisms: Medicago truncatula, Trigonella foenum-graecum
MSLVANEEFQHILRVLNTNVDGKQKIQFAMTSIKGIGRRFANICCKKADVDMNKRAGELTAAELENIMTVVANPRQFKVPDWFLNRKKDYKDGKFSQVVSNQLDMKLRDDLERLKKIRNHRGLRHYWGLRVRGQHTKTTGRRGKTVGVSKKR

SEQ ID NO: 6453 - protein, 152 aa, Carica papaya
MSLVANEDFQHILRVLNTNVDGKQKIMFALTSIKGVGRRFANIVCKKADVDMNKRAGELTAAELDNLMVIVANPRQFKIPDWFLNRQKDYKDGKFSQVVSNALDMKLRDDLERLKKIRNHRGLRHYWGLRVRGQHTKTTGRRGKTVGVSKKR

SEQ ID NO: 6454 - protein, 152 aa, Glycine max
MSLVANEDFQHILRVLNTNVDGKQKIMFAMTSIKGIGRRFANIACKKADVDMNKRAGELTAAELDSVMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6455 - protein, 152 aa, Tripterygium wilfordii
MSLVANEDFQHILRVLNTNVDGKQKIMFALTSIKGIGRRFANIVCKKADVDMNKRAGELTPAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6456 - protein, 84 aa, Secale cereale
MSLIAGEEFQHILRVLNTNVDGKQKIMFALTSIKGVGRRFSNIVCKKADIDMNKRAGELSAEEMDRLMAVVHNPRQFKVAGLVP

SEQ ID NO: 6457 - protein, 152 aa, Unknown
  Sequence found in Organisms: Fraxinus spp, Olea europaea
MSLIANEDFQHILRVQNTNVDGKQKIMFALTSIKGIGRRFANIVCKKADIDMNKRAGELSAAEIDSLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6458 - protein, 152 aa, Glycine max
MSLVANEDFQHILRVLNTNVDGKQKIMFAMTSIKGIGRRFANIACKKADVDMNKRAGELTAAELDSVMTVVANPRQFKIPNWFLNRKKDYKDGKYSQVVSNALDMKLRDDLERLKKIRNHRGLRHYWGLRVRGQHTKTTGRRGKTVGVSKKR

SEQ ID NO: 6459 - protein, 152 aa, Malus domestica
MSLVANEEFQHILRVLNTNVDGKQKIMFALTSIKGIGRRFANIVCKKADVDMNKRAGELSAAELDTLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6460 - protein, 152 aa, Unknown
  Sequence found in Organisms: Aquilegia formosa, Thalictrum flavum
MSLVANEDFQHILRVLNTNVDGKKKIMFALTSIKGIGRRYANIVCKKADVDMNKRAGELTAAELENLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6461 - protein, 152 aa, Aquilegia formosa
MSLVANEDFQHILRVLNTNVDGKKKIMFALTSIKGIGRRLANIVCKKADVDMNKRAGELSAAELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6462 - protein, 152 aa, Musa acuminata
MSLVANEDFQHILRVLNTNVDGKQKIMFALTSIKGIGRRFANIVCKKADVDMNKRAGELSAAELENLMTVVANPRQFKIPDWFLNRKKDYKDGRYSQIVSNSLDMKLRDDLERLKKIRNHRGLRHFWGLRVRGQHTKTTGRRGKTVGVSKKR

SEQ ID NO: 6463 - protein, 152 aa, Musa acuminata
MSLVANEDFQHILRVLNTNVDGKQKIMFALTSIKGIGRRFANIVCKKADVDMNKRAGEISAAELENLMTIVANPRQFKIPDWFLNRKKDYKDGRYSQVVSNALDMKLRDDLERLKKIRNHRGLRHFWGLRVRGQHTKTTGRRGKTVGVSKKR

SEQ ID NO: 6464 - protein, 152 aa, Unknown
  Sequence found in Organisms: Gossypium hirsutum, Theobroma cacao, Gossypium raimondii
MSLVANEDFQHILRVLNTNVDGKQKIMFALTSIKGIGRRFANIVCKKADVDMNKRAGELTAQELDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6465 - protein, 152 aa, Unknown
  Sequence found in Organisms: Cephalotaxus harringtonia, Taxus baccata
MSLIANEDFQHILRVLNTNVDGRQKIMFALTSIKGIGRRFANIVCKKADVDMSKRAGELSAQELENLMVIVANPRQFKIPDWFLNRKKDHKDGRFSQVVSNALDMKLRDDLERLKKIRNHRGLRHYWGLRVRGQHTKTTGRRGKTVGVSKKR

SEQ ID NO: 6466 - protein, 152 aa, Cleome spinosa
MSLVANEDFQHILRVLNTNVDGKQKIMFALTSIKGIGRRFANIVCKKADVDMNKRAGELSAAELDNLMTIVANPRQFKIPDWFLNRQKDYKDGKFSQVVSNALDMKLRDDLERLKKIRNHRGLRHYWGLRVRGQHTKTTGRRGKTVGVSKKR

SEQ ID NO: 6467 - protein, 152 aa, Unknown
  Sequence found in Organisms: Cucumis sativus, Euphorbia peplus, Cucumis melo, Euphorbia esula, Citrullus lanatus
MSLVANEDFQHILRVLNTNVDGKQKIMFALTSIKGIGRRFANIVCKKADVDMNKRAGELTAAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6468 - protein, 152 aa, Cyamopsis tetragonoloba
MSLVANEDFQHILRVLNTNVDGKQKIMFALTSIKGIGRRFANICCKKADVDMNKRAGELSAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6469 - protein, 152 aa, Euonymus alatus
MSLVANEDFQHILRVLNTNVDGKDKIMFALTSIKGIGRRFANIVCKKADVDMNKRAGELTPAELDSLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6470 - protein, 152 aa, Euonymus alatus
MSLVANEDFQHILRVLNTNVDGKDKIMFALTSIKGIGRRFANIVCKKADVDMNKRAGELTPAELDNLMGVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6471 - protein, 152 aa, Linum usitatissimum
MSLVANEEFQHILRVLNTNVDGKQKIMFALTSIKGIGRRFANIVCKKADVDMNKRAGELSSEELDKLMTVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6472 - protein, 152 aa, Vitis vinifera
MSLVANEEFQHILRVLNTNVDGKQKIMFALTSIKGIGRRFANIVCKKADVDMNKRAGELSAAELENLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6473 - protein, 152 aa, Carpinus betulus
MSLVANEEFQHILRVLNTNVDGKQKIMFALTSIKGIGRRFANIVCKKADVDMNKRAGELTAAELDNLMTIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6474 - protein, 152 aa, Mesembryanthemum crystallinum
MSLVANEEFQHILRLLNTNVDGKQKIMFAMTSIKGIGRRFANICCKKADIDMNKRAGELTTTELDNLMTVVQNPRQFKIPDYFLNRQKDYKDGRFSQVLSNQLDMKLRDDLERLKKIRNHRGLRHYWGLRVRGQHTKTTGRRGKTVGVSKKR

SEQ ID NO: 6475 - protein, 152 aa, Unknown
  Sequence found in Organisms: Ipomoea batatas, Ipomoea nil
MSLVANEDFQHILRILNTNVDGKQKIMFALTSIKGIGRRFANICCKKADIDMNKRAGELSSAEIDNLMTVVANPRQFKVPDWFLNRQKDYKDGGYSQVVSNALDMKLRDDLERLKKIRNHRGLRHYWGLRVRGQHTKTTGRRGKTVGVSKKR

SEQ ID NO: 6476 - protein, 152 aa, Glycyrrhiza uralensis
MSLVANEEFQHILRVLNTNVDGKQKIMFAMTSIKGIGRRFANICCKKADVDMNKRAGELSAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6477 - protein, 152 aa, Glycyrrhiza uralensis
MSLVANEDFQHILRVLNTNVDGKQKIMFALTSIKGIGRRFANIVCKKADVDMNKRAGELTAAELDQLMVIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6478 - protein, 152 aa, Nuphar advena
MSLITNEDFQHILRILNTNVDGRQKIMFALTSIKGVGRRFANIACKKADIDMNKRAGELSSAELEQLMVIVANPRQFKIPDWFLNRKKDYKDGRYSQVVSNSLDMKLRDDLERLKKIRNHRGLRHYWGLRVRGQHTKTTGRRGKTVGVSKKR

SEQ ID NO: 6479 - protein, 147 aa, Avena sativa
GEEFQHILRVLNTNADGKQKIMFALTSIKGIGRRFSNIVCKKADIDMNKRAGELTTEEMERLMTVVHNPRQFKVPDWFLNRKKDYKDGRFSQVVSNQVDMKLRDDLERLKKIRNHRGLRHYWGVRVRGQHTKTTGRRGKTVGVSKKR

SEQ ID NO: 6480 - protein, 152 aa, Avena sativa
MSLISGEEFQHILRLLNTNVDGKQKIMFALTSIKGIGRRYSNIVCKKADLDMNKRAGELTTEELDRVMNVVQNPRSFKVPDWFLNRKKDYKDGRYSQVVSNGVDMKLRDDLERLKKIRNHRGLRHYWGVRVRGQHTKTTGRRGKTVGVSKKR

SEQ ID NO: 6481 - protein, 152 aa, Elaeis guineensis
MSLVANEDFQHILRVLNTNVDGKQNVMFALTSIKGIGRRFANIVCKKADVDMNKRAGELSAEELENLMVVVANPRQFKIPDWFLNRKKDHKDGRYSQVVSNALDMKLRDDLERLKKIRNHRGLRHYWGLRVRGQHTKTTGRRGKTVGVSKKR

SEQ ID NO: 6482 - protein, 152 aa, Lippia dulcis
MSLVASEDFQHILRVQNTNVDGKQKIMFAMTSIKGVGRRFANIVCKKADIDMNKRAGELSAAEIDSLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6483 - protein, 152 aa, Cajanus cajan
MSLVANEDFQHILRVLNTNVDGKQNIMFALTSIKGIGRRFANICCKKADVDMNKRAGELTAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6484 - protein, 152 aa, Cajanus cajan
MSLVANEDFQHILRVLNTNVDGKQKIMFALTSIKGIGRRFANMVCKKADVDMNKRAGELSAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6485 - protein, 152 aa, Platanus occidentalis
MSLVANEEFQHILRVLNTNVDGKQKIMFALTSIKGIGRRFANIVCKKADVDMNKRAGELSAQELENLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6486 - protein, 152 aa, Populus trichocarpa
MSLVANEDFQHILRVLNTNVDGKQKIMFALTSIKGIGRRFSNIVCKKADVDMNKRAGELSAAELDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6487 - protein, 152 aa, Papaver somniferum
MSLVANEDFQHILRVLNTNVDGKQKVMYALTSIKGIGRRFANIVCKKADVDMNKRAGELSAAELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6488 - protein, 152 aa, Salvia sclarea
MSLVANEDFQHILRVQNTNVDGKQKIMFAMTSIKGIGRRFANIVCKKADVDMNKRAGELTAAELDSLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6489 - protein, 152 aa, Glycine max
MSLVANEDFQHILRVLNTNVDGKQKIMFALTSIKGIGRRFSNICCKKADVDMNKRAGELSAAELDSVMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6490 - protein, 152 aa, Glycine max
MSLVANEDFQHILRVLNTNVDGKQKIMFAMTSIKGIGRRFANIACKKADVDMNKRAGELSAAELDSVMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6491 - protein, 152 aa, Solanum lycopersicum
MSLVANEDFQHILRVQNTNVDGKQKIMFAMTSIKGIGRRFANIACKKADIDMNKRAGELTAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6492 - protein, 152 aa, Tripterygium wilfordii
MSLVANEEFQHILRVLNTNVDGKQKIMFALTSIKGIGRRFANIVCKKADVDMNKRAGELTPAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6493 - protein, 152 aa, Tripterygium wilfordii
MSLVANEEFQHILRVLNTNVDGKQKIMFALTSIKGIGRRFANIVCKKADVDMNKRAGELTAAELENLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6494 - protein, 152 aa, Valeriana officinalis
MSLVANEEFQHILRVQNTNVDGKQKIMFAMTSIKGIGRRFSNIVCKKADIDMNKRAGELSNAEIDGLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6495 - protein, 152 aa, Zostera marina
MALVANEDFQHILRVLNTNVDGKRKIMYALTSIKGIGRRFANIVCKKADVDMNKRAGEISAEELETLMTIVANPRQFKIPDWFLNRKKDYKDGRFSQVVSNALDMKLRDDLERLKKIRNHRGLRHYWGLRVRGQHTKTTGRRGKTVGVSKKR

SEQ ID NO: 6496 - protein, 1739 aa, Malus domestica
MLRSGKVRGERDKQIVVQKKGDELKQGGSDSGGEKTRHLVSGGAEESEKELEGGEDGDVGGNENGGATESGKKRCVGNGEEIGDDKKRVKEKEADSEVRIFGRVLKSQSAANGGGDKEVNDGELVAENRENDGTQKQCSEVNNKGRKEMKVDGKVQAIGWVLQSQSAVNGGYDKEVSDGGLVEEGRENDGSHKQRSEVNNEWRKEMEVDGAVQVVGRVLQAQSAVNGGCDKDVSDGVLVAGIRESDGSDKQCSEVKDEGADLLGQSENVGVGEIGKKRRQGDNGEEIDDDALEEKKVKEDEVDGKVLTTVRVLRSRVVVNEGCDKAGSDGSCKKSSKGGDQLVERFTKKLKGKRGSPLKMKNFKRKRGRPKKVEKEQSDLSVGQLRKEESDGSGAGLHKMKILKRKRGRPKKVEKEQSDLSVGQLRKEESDGSGAGQQKMKNLKRKRGRPKKVEREESDLSVGWLRKEESHGSGAGLLQMKNLKRKRGRPKKVEKEESDLSVGRLRKKSKLKHKRSLKVQKTNVALKGKLAKEGNMVLRSQERIKASMTTNGSYLERRIIGKELDVKAFSPAKRDKKGNDLETDDSEDGEGSNERKQKQKGNKGQKNKQKSRDGDCARSRQKQLVRDKIVDLIMRAGWTIQYRPRNGKEYKDAVYVTPAGQTHWSVTKAYTTLKAHCENGENNSKFCKPGFKFTLIPPEEIDMLARIQVVKRVGKKKGKKGKNGMEGGKKKRRGNTVDGVTEEKKKKKLGRPLKGKRLLLEKDDSARAACKGRRSLYKTKNRKRCALLVRNSENADSDDDGHVLYDGKRTVLAWMIDLGTLSLNSKVKYMNRRKTQVLLEGNITRDGIHCGCCGETISISKFVTHAKSDYSEPFKHIYLDSGSTLLQCLLDSWNRQDEYDRRGFHFVGVNREDPNDDTCGICGDGGNLICCDGCPSTFHQNCLEIKAKDAVNDDSNDPSFCGKNCQELFASLQMLLGVRQEIEDGFSLTLIHRSDTSSISICDTPQIDDCDSKLIECNSKLAVAFLLMDECFLPMVDHRSGVNLIHNILYNRGSNFSRLNYSGFLTAILERGDEIISAASIRIHGNYLAEMPFVGTRYMYRRQGMCRRLLIGIESALSSLNVERLVIPAISELRETWTSVFGFKPLEESSKQRMKNMNILVFPGVDILEKPVSKHLTEANMIPAEGVRSTELEHQQLEQEVLCDINEKRLVASGIEASAPCGSEASDELADVESDTQHHCGVSQDNLEEKSNTIIIPPPSMCDIHEQTEEVNQSSASVPDVGTVEVDTQQDQHIMLEVENKSLTSHHSSSVRNHNSHDERSICRSTENNTTEQQHIAHEVKVSDEITVCHDSATTTEASHEASDLKHQDSLSVQVAGSIFCPDGKMSETCEAECNHPSTQHTPAVIVEEHPESIKCYGSEILTGTSEVASDILHPTPLLPHQKADELEGNRLNTHKVADGFEGNGLNTHNVADEFKGNGLNTQKVDSALTCGHAKSPEVTDLNLTPEESQNTTSVKQSELDSQTSPTQCNSSNTPVVALHCASGGGTSGAVILSNQARVSLSFASVFTAHTQRRRAAPKASRSETLAMSLVANEEFQHILRVLNTNVDGKQKIMFALTSIKGIGRRFANIVCKKADVDMNKRAGELSAAELDTLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6497 - protein, 946 aa, Theobroma cacao
MASPSERWIDGLQFSSLFWPPPQDPQQRKVQITAYVEYFGQFTSEQFPEDIAELVRNRYPHKEQRLFDDVLAMFVLHHPEHGHAVVLPIISCIIDGTLVYDKSTPPFASFISLVCPSSENEYSEQWALACGEILRILTHYNRPIYKMEQQNSETDRSNSSGQATTSEPVDGEPSFHIPLMQQERKPLRPLSPWITDILLAAPLGIRSDYFRWCSGVMGKYAAGDLKPPSTASSRGSGKHPQLMPSTPRWAVANGAGVILSVCDEEVARYETATLTAAAVPALLLPPPTTALDEHLVAGLPALEPYARLFHRYYAIATPSATQRLLLGLLEAPPSWAPDALDAAVQLVELLRAAEDYATGIRLPRNWMHLHFLRAIGTAMSMRAGIAADAAAALLFRILSQPALLFPPLRQVEGVEVQHEPSGGYISCYRKQIEVPAAEATIEATAQGIASMLCAHGPEVEWRICTIWEAAYGLIPLSSSAVDLPEIIVATPLQPAILSWNLYIPLLKVLEYLPRGSPSEACLMKIFVATVEAILQRTFPPESSRVQTRKTRYSIGSASKNLAVAELRTMVHSLFLESCASVELASRLLFVVLTVCVSHEAQFSGSKRPRCEESYPPDEGIEESQSPSERPRDIKPRKTKKQGPVAAFDSYVLAAVCALACELQLFPLVTRGSNHSTAKDVQAIAKPAKLNGSSIEYGHSIDSAIHHTHRILAILEALFSLKPSSVGTSWSYSSNEIVAAAMVAAHVSELFRRSKACMHALSVLMRCKWDNEIYTRASSLYNLIDIHSKAVASIVNKAEPLEAQLIHAPVWKDSPVCLDGRKQNKRTNTTCFDPGQSSASECEDSTHSDKNLRCERVLASDEGSGNSLGKGIASFPLDASDLANFLTMDRHIGFNCSAQILLRSVLVEKQELCFSVVSLLWHKLIAAPETQPSAESTSAQQGWRQVI

SEQ ID NO: 6498 - protein, 83 aa, Lippia dulcis
MSLVANEDFQHILRVQNTNVDGKQKIMFAMTSIKGIGRRFANIVCKKADIDMNKRAGELTAAEIDSLMVIVANPRQFKIPTGF

SEQ ID NO: 6499 - protein, 162 aa, Fraxinus spp
MSLIANEDFQHILRVQNTNVDGKQKIMFALTSIKGIGRRFANIVCKKADIDMNKRAGELSAAEIDSLMTIVANPRKFKIPDWFLNRKKDYKDGKFSQVTSNALDMKLRDDLERLKKIRNHRGLRHYWGLRVRGQHTKTTGRRGKNCWCLQEAMSLNFLYCSL

SEQ ID NO: 6500 - protein, 101 aa, Primula obconica
MNKRAGELTAQELENLMTIVANPRQFNIPDWFLNRKKDYKDGKFSQVTSNALDMKLRDDLERLKKIRNHRGLRHYWGLRVRGQHTKTTGRRGKTVGVSKKR

SEQ ID NO: 6501 - protein, 126 aa, Citrullus lanatus
MFALTSIKGIGRRFANIVCKKADVDMNKRAGELTAAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6502 - protein, 152 aa, Unknown
  Sequence found in Organisms: Manihot esculenta, Ricinus communis
MSLVANEDFQHILRVLNTNVDGKQKIMFALTSIKGIGRRFANIVCKKADVDMNKRAGELTAAELDNLMVIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6503 - protein, 152 aa, Centaurea maculosa
MSLVANEDFQHILRVQNTNVDGKQKIMFAMTSIKGIGRRFSNIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6504 - protein, 152 aa, Unknown
  Sequence found in Organisms: Malus domestica, Prunus persica, Prunus persica, Prunus mume
MSLVANEEFQHILRVLNTNVDGKQKIMFALTSIKGIGRRFANIVCKKADVDMNKRAGELSAAELDNLMTIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6505 - protein, 152 aa, Unknown
  Sequence found in Organisms: Prunus persica, Prunus persica, Prunus mume
MSLVANEEFQHILRVLNTNVDGKKKIMFALTSIKGIGRRFANIVCKKADVDMNKRAGELSAAELDNLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6506 - protein, 152 aa, Acacia harpophylla
MSLVANEDFQHILRVLNTNVDGKQKIMFALTSIKGIGRRFANIVCKKADVDMNRRAGELSAAELDQLMTIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6507 - protein, 152 aa, Amborella trichopoda
MSLIANEEFQHILRVLNTNVDGRQKIMFALTSIKGIGRRFANLVCKKADIDMNKRAGELSAAELESLMVIVANPRQFKIPDWFLNRKKDYKDGRYSQVVSNALDMKLRDDLERLKKIRNHRGLRHHWGLRVRGQHTKTTGRRGKTVGVSKKR

SEQ ID NO: 6508 - protein, 151 aa, Aquilegia formosa
SLVANEDFQHILRVLNTNVDGKKKIMFALTSIKGIGRRYANIVCKKADVDMNKRAGELTAAELENLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6509 - protein, 152 aa, Musa acuminata
MSLVANEDFQHILRVLNTNVDGKQKIMFALTSIKGIGRRFANIVCKKADVDMNKRAGEISAAELENLMTVVANPRQFKIPDWFLNRKKDYKDGRYSQIVSNSLDMKLRDDLERLKKIRNHRGLRHFWGLRVRGQHTKTTGRRGKTVGVSKKR

SEQ ID NO: 6510 - protein, 152 aa, Ocimum basilicum
MSLVANEDFQHILRVQNTNVDGKQKIMFAMTSIKGIGRRFANIVCKKADIDMNKRAGELSAAEIDSLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6511 - protein, 152 aa, Ocimum basilicum
MSLVANEDFQHILRVQNTNVDGKQKIMFAMTSIKGIGRRFANIACKKADIDMNKRAGELTAAELDSLMVVVANPRQFKIPDWFLNRQKDYKDGKFSQVTFNALDMKLRDDLERLKKIRNHRGLRHYWGLRVRGQHTKTTGRRGKTVGVSKKR

SEQ ID NO: 6512 - protein, 152 aa, Vaccinium corymbosum
MSLVANEEFQHILRVQNTNVDGKQKIMFALTSIKGIGRRFSNIACKKADIDMNKRAGELSSQELDNLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6513 - protein, 152 aa, Unknown
  Sequence found in Organisms: Cannabis sativa, Humulus lupulus
MSLVANEEFQHILRVLNTNVDGKQKIMFALTSIKGIGRRFANLVCKKADVDMNKRAGELSAAELDTLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6514 - protein, 152 aa, Unknown
  Sequence found in Organisms: Manihot esculenta, Ricinus communis
MSLVANEDFQHILRVLNTNVDGKQKIMFALTSIKGIGRRFANIVCKKADVDMNKRAGELSAEELDKLMVIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6515 - protein, 152 aa, Unknown
  Sequence found in Organisms: Castanea mollissima, Quercus alba
MSLVANEDFQHILRVLNTNVDGKQKIMFALTSIKGIGRRFANLVCKKADVDMNKRAGELTAAELDNLMVIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6516 - protein, 152 aa, Unknown
  Sequence found in Organisms: Castanea mollissima, Quercus alba
MSLVANEDFQHILRVLNTNVDGKQKIMFALTSIKGIGRRFANLVCKKADVDMNKRAGELSAAELDNLMTIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6517 - protein, 152 aa, Cicer arietinum
MSLVANEEFQHILRVLNTNVDGKQKIMFALTSIKGIGRRFANICCKKADVDMNKRAGELSAAELDNLMTVVANPRQFKIPDWFLNRKKDYKDGKFSQVVSNSLDMKLRDDLERLKKIRNHRGLRHYWGLRVRGQHTKTTGRRGKTVGVSKKR

SEQ ID NO: 6518 - protein, 152 aa, Unknown
  Sequence found in Organisms: Citrus clementina, Citrus sinensis
MSLVANEDFQHILRVLNTNVDGKQKIMFALTSIKGIGRRLANIVCKKADVDMNKRAGELSAAELDQLMVVVANPRQFKIPDWFLNRQKDYKDGRYSQVVSNALDMKLRDDLERLKKIRNHRGLRHYWGLRVRGQHTKTTGRRGKTVGVSKKR

SEQ ID NO: 6519 - protein, 152 aa, Unknown
  Sequence found in Organisms: Cleome gynandra, Cleome spinosa
MSLVANEDFQHILRVLNTNVDGKQKIMFALTSIKGIGRRFANIVCKKADVDMNKRAGELSAAELDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6520 - protein, 152 aa, Unknown
  Sequence found in Organisms: Cryptomeria japonica, Sequoia sempervirens
MSLIANEEFQHILRVLNTNVDGRQKIMFALTSIKGIGRRFANIVCKKADVDMSKRAGELSAQELENLMVIVANPRQFKIPDWFLNRKKDHKDGRFSQVVSNALDMKLRDDLERLKKIRNHRGLRHYWGLRVRGQHTKTTGRRGKTVGVSKKR

SEQ ID NO: 6521 - protein, 152 aa, Cucurbita pepo
MSLVANEDFQHILRVLNTNVDGKQKIMFALTSIKGIGRRLANIVCKKADVDMNKRAGELTAAELDNLMVIVANPRQFKVPDWFLNRQKDYKDGKYSQVVSNALDMKLRDDLERLKKIRNHRGLRHYWGLRVRGQHTKTTGRRGKTVGVSKKR

SEQ ID NO: 6522 - protein, 152 aa, Cyamopsis tetragonoloba
MSLVANEDFQHILRVLNTNVDGKQKIMFALTSIKGIGRRFANIACKKADVDMNKRAGELSAAELDSIMAVVANPRQFKVPDWFLNRKKDYKDGKYSQVVSNALDMKLRDDLERLKKIRNHRGLRHYWGLRVRGQHTKTTGRRGKTVGVSKKR

SEQ ID NO: 6523 - protein, 152 aa, Distylium racemosum
MSLIANEDFQHILRVLNTNVDGRQKIMFALTSIKGIGRRFANIVCKKADVDMNKRAGELSAAELENLMVIVANPRQFKIPDWFLNRKKDHKDGRYSQVVANALDMKLRDDLERLKKIRNHRGLRHYWGLRVRGQHTKTTGRRGKTVGVSKKR

SEQ ID NO: 6524 - protein, 152 aa, Distylium racemosum
MSLIANEDFQHILRVLNTNVDGRQKIMFALTSIKGIGRRFANIVCKKADVDMNKRAGELSAQELEQLMVIVANPRQFKIPDWFLNRKKDHKDGRYSQVVANALDMKLRDDLERLKKIRNHRGLRHYWGLRVRGQHTKTTGRRGKTVGVSKKR

SEQ ID NO: 6525 - protein, 152 aa, Eucalyptus grandis
MSLVANEEFQHILRVLNTNVDGKQKIMFALTSIKGIGRRFANIVCKKADVDMNKRAGELTAAELDNLMVIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6526 - protein, 152 aa, Euonymus alatus
MSLVANEDFQHILRVLNTNVDGKDKIMFALTSIKGIGRRFANIVCKKAEVDMNKRAGELTPAELDSLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6527 - protein, 152 aa, Euonymus alatus
MSLVANEDFQHILRVLNTNVDGKDKIMFALTSIKGIGRRFANIVCKKADVDMNKRAGELTPAELDNLMAVVANPRRFKIPDWFLNRQKDYKDGKYSQVVSNALDMKLRDDLERLKKIRNHRGLRHYWGLRVRGQHTKTTGRRGKTVGVSKKR

SEQ ID NO: 6528 - protein, 152 aa, Linum usitatissimum
MSLVANEEFQHILRVLNTNVDGKQKIMFALTSIKGIGRRFANIVCKKADVDMNKRAGELSSEELDKLMTVVANPRQFKIPDWFLNRQKDYKDGKYSQVVSNAVDMKLRDDLERLKKIRNHRGLRHYWGLRVRGQHTKTTGRRGKTVGVSKKR

SEQ ID NO: 6529 - protein, 152 aa, Linum usitatissimum
MSLVANEEFQHILRVLNTNVDGKQKIMFALTSIKGIGRRFANIVCKKADVDMNKRAGELSSEELDKLMTVVANPRQFKIPDWFLNRQKDYKDGKYSQVVSNALDMKLRDDLERLKKIRNHRGLRHYWGLTVRGQHTKTTGRRGKTVGVSKKR

SEQ ID NO: 6530 - protein, 152 aa, Fraxinus spp
MSLIANEEFQHILRVQNTNVDGKQKIMFALTSIKGIGRRFANIVCKKADIDMNKRAGELSAAEIDSLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6531 - protein, 152 aa, Gerbera hybrid cultivar
MSLVANEDFQHILRVQNTNVDGKQKIMFAMTSIKGIGRRFANIVCKKADIDMNKRAGELSNAEIDSLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6532 - protein, 152 aa, Ipomoea batatas
MSLVANEDFQHILRILNTNVDGKQKIMFALTPIKGIGRRFANICCKKADIDMNKRAGELSAAEIDNLMTVVANPRQFKVPDWFLNRQKDYKDGGYSQVVSNALDMKLRDDLERLKKIRNHRGLRHYWGLRVRGQHTKTTGRRGKTVGVSKKR

SEQ ID NO: 6533 - protein, 152 aa, Actinidia deliciosa
MSLVANEEFQHILRVQNTNVDGKQKIMFALTSIKGIGRRFANIVCKKADVDMNKRAGELTAQELDNLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6534 - protein, 152 aa, Medicago truncatula
MSLVANEEFQHILRVLNTNVDGKQKIQFAMTSIKGIGRRFANICCKKADVDMNKRAGELSAAELDNIMTVVANPRQFKVPDWFLNRKKDYKDGKFSQVVSNQLDMKLRDDLERLKKIRNHRGLRHYWGLRVRGQHTKTTGRRGKTVGVSKKR

SEQ ID NO: 6535 - protein, 152 aa, Momordica charantia
MSLVANEEFQHILRVLNTNVDGKQKIMFALTSIKGIGRRFANIVCKKADVDMNKRAGELTAAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6536 - protein, 152 aa, Nuphar advena
MSLISNEDFQHILRIVNTNVDGRQKIMFALTSIKGIGRRFANIICKKADIDMNKRAGELSAAELEQLMVIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6537 - protein, 152 aa, Capsicum annuum
MSLVANEDFQHILRVQNTNVDGKQKIMFAMTSIKGIGRRFANIACKKADIDMNKRAGELSAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6538 - protein, 152 aa, Physcomitrella patens
MSLIAGEEFQHILRVLNTNVDGRQKIMFALTSIKGVGRRFANLVCKKADVDMSKRAGELSAAELENLMVIVANPRQFKVPDWFLNRKKDHKDGRYSQVVSNALDMKLRDDLERLKKIRNHRGLRHYWGLRVRGQHTKTTGRRGRTVGVSKKR

SEQ ID NO: 6539 - protein, 152 aa, Physcomitrella patens
MSLIAGEEFQHILRVLNTNVDGRQKIMFALTSIKGVGRRFANLVCKKADVDMSKRAGELSAAELENLMVIVANPRQFKIPDWFLNRKKDHKDGRFSQVVSNALDMKLRDDLERLKKIRNHRGLRHYWGLRVRGQHTKTTGRRGRTVGVSKKR

SEQ ID NO: 6540 - protein, 152 aa, Cajanus cajan
MALVANEDFQHILRVLNTNVDGKQKIMFALTSIKGIGRRFANMVCKKADVDMNKRAGELSAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6541 - protein, 152 aa, Populus trichocarpa
MSLVANEEFQHILRVLNTNVDGKQKIMFALTSIKGIGRRFANIVCKKADVDMNKRAGELSAEELDKLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6542 - protein, 152 aa, Papaver somniferum
MSLVANEDFQHILRVLNTNVDGKQKIMFALTSIKGIGRRFANIVCKKADVDMNKRAGELSAAELENLMVIIANPRQFKIPDWFLNRKKDYKDGRYSQVVSNALEMKLRDDLERLKKIRNHRGLRHYWGLRVRGQHTKTTGRRGKTVGVSKKR

SEQ ID NO: 6543 - protein, 152 aa, Unknown
  Sequence found in Organisms: Solanum tuberosum, Solanum phureja
MSLVANEEFQHILRVQNTNVDGKQKIMFAMTSIKGIGRRFANIACKKADIDMNKRAGELTAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6544 - protein, 146 aa, Secale cereale
EEFQHILRVLNTNVDGKQKIMFALTSIKGVGRRFSNIVCKKADIDMNKRAGELSAEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 6545 - protein, 152 aa, Salvia sclarea
MSLVANEDFQHILRVQNTNVDGKQKIMFAMTSIKGIGRRFANIVCKKADVDMNKRAGELSAAELDSLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6546 - protein, 152 aa, Salvia sclarea
MSLVANEDFQHILRVQNTNVDGKQKIMFAMTSIKGIGRRFANIVCKKADIDMNKRAGELSNAEIDSLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6547 - protein, 152 aa, Scabiosa columbaria
MSLVANEEFQHILRIQNTNVDGKQKIMFAMTSIKGIGRRFSNIVCKKADIDMNKRAGELSSAEIDSLMTIVGNPRQFKIPDWFLNRKKDYKDGKFSQVTSNALDMKLRDDLERLKKIRNHRGLRHYWGLRVRGQHTKTTGRRGKTVGVSKKR

SEQ ID NO: 6548 - protein, 152 aa, Sciadopitys verticillata
MSLIADEEFQHILRVLNTNVDGRQKIMFALTSIKGIGRRFANIVCKKADVDMSKRAGELSAQELENLMVIVANPRQFKIPDWFLNRKKDHKDGRFSQVVSNALDMKLRDDLERLKKIRNHRGLRHYWGLRVRGQHTKTTGRRGKTVGVSKKR

SEQ ID NO: 6549 - protein, 152 aa, Silene vulgaris
MSLVANEEFQHILRILNTNVDGKQKIMFALTSIKGIGRRYANICCKKADIDMNKRAGELSTAELDNLMTVVANPRQFKIPDWFLNRQKDYKDGRFSQVVSNQLDMKLRDDLERLKKIRNHRGLRHYWGLRVRGQHTKTTGRRGKTVGVSKKR

SEQ ID NO: 6550 - protein, 152 aa, Silene vulgaris
MSLVANEDFQHILRILNTNVDGKQKIMFAMTSIKGIGRRYANICCKKADIDMNKRAGELSTAELENLMNVVQTPRQFKIPDWFLNRQKDYKDGRFSQVVSNQLDMKLRDDLERLKKIRNHRGLRHYWGLRVRGQHTKTTGRRGKTVGVSKKR

SEQ ID NO: 6551 - protein, 152 aa, Glycine max
MSLVANEDFQHILRVLNTNVDGKQKIMFALTSIKGIGRRFANICCKKADVDMNKRAGELSAIELDSVMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6552 - protein, 152 aa, Solanum lycopersicum
MSLVANEDFQHILRVQNTNVDGKQKIMFAMTSIKGIGRRFANIACKKADIDMSKRAGELTAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6553 - protein, 152 aa, Valeriana officinalis
MSLVANEEFQHILRVQNTNVDGKQKIMFAMTSIKGIGRRFANIVCKKADIDMNKRAGELSNAEIDGLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6554 - protein, 152 aa, Zamia vazquezii
MSLIANEDFQHILRVLNTNVDGRQKIMFALTSIKGVGRRFANLVCKKADVDMNKRAGELSAAELENLMVIVGNPRQFKIPDWFLNRKKDHKDGRYSQVVSNALDMKLRDDLERLKKIRNHRGLRHYWGLRVRGQHTKTTGRRGKTVGVSKKR

SEQ ID NO: 6555 - protein, 152 aa, Unknown
  Sequence found in Organisms: Phaseolus vulgaris, Vigna unguiculata
MALVANEEFQHILRVLNTNVDGKQKIMFALTSIKGIGRRFANMVCKKADVDMNKRAGELSAAELDNLMTVVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6556 - protein, 152 aa, Unknown
  Sequence found in Organisms: Arnica chamissonis, Artemisia annua, Centaurea maculosa, Cichorium intybus, Cirsium arvense, Cynara scolymus, Taraxacum officinale, Flaveria ramosissima, Carthamus tinctorius, Helianthus annuus, Tragopogon dubius
MSLVANEDFQHILRVQNTNVDGKQKIMFAMTSIKGIGRRFANIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6557 - protein, 152 aa, Unknown
  Sequence found in Organisms: Nicotiana benthamiana, Petunia hybrida, Nicotiana tabacum
MSLVANEEFQHILRVQNTNVDGKQKIMFAMTSIKGIGRRFANIACKKADIDMNKRAGELSAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6558 - protein, 152 aa, Unknown
  Sequence found in Organisms: Fraxinus spp, Olea europaea
MSLIANEDFQHILRVQNTNVDGKQKIMFALTSIKGIGRRFANIVCKKADIDMNKRAGELSAAEIDSLMTIVGNPRQFKIPDWFLNRKKDYKDGKYSQVTSNALDMKLRDDLERLKKIRNHRGLRHYWGLRVRGQHTKTTGRRGKTVGVSKKR

SEQ ID NO: 6559 - protein, 152 aa, Unknown
  Sequence found in Organisms: Ambrosia trifida, Arnica chamissonis, Flaveria ramosissima, Guizotia abyssinica, Parthenium argentatum, Helianthus annuus
MSLVANEDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6560 - protein, 152 aa, Antirrhinum majus
MSLVANEEFQHILRVQNTNVDGKQKIMFAMTSIKGIGRRFANIVCKKADVDMNKRAGELSNAEIDNLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6561 - protein, 152 aa, Aristolochia fimbriata
MSLVANEDFQHILRVLNTNVDGKQKIMFALTSIKGIGRRLANIVCKKADVDMNKRAGELSAAELESLMVIVANPRQFRIPDWFLNRQKDYKDGRYSQVVSNALDMKLRDDLERLKKIRNHRGLRHYWGLRVRGQHTKTTGRRGKTVGVSKKR

SEQ ID NO: 6562 - protein, 152 aa, Fagus grandifolia
MSLVANEEFQHILRVLNTNVDGKQKIMFALTSIKGIGRRFANLVCKKADVDMNKRAGELTAAELDNLMVIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6563 - protein, 152 aa, Ceratodon purpureus
MSLIAGEEFQHILRVLNTNVDGRQKIMFALTSIKGVGRRFANLVCKKADLDMSKRAGELSAAELENLMVIVANPRQFKIPDWFLNRKKDHKDGRYSQVVSNALDMKLRDDLERLKKIRNHRGLRHYWGLRVRGQHTKTTGRRGRTVGVSKKR

SEQ ID NO: 6564 - protein, 152 aa, Unknown
  Sequence found in Organisms: Ceratodon purpureus, Physcomitrella patens
MSLIAGEEFQHILRVLNTNVDGRQKIMFALTSIKGVGRRFANLVCKKADVDMSKRAGELSAAELENLMVIVANPRQFKIPDWFLNRKKDHKDGRYSQVVSNALDMKLRDDLERLKKIRNHRGLRHYWGLRVRGQHTKTTGRRGRTVGVSKKR

SEQ ID NO: 6565 - protein, 152 aa, Cicer arietinum
MSLVANEEFQHILRVLNTNVDGKQKIMFALTSIKGIGRRFANIACKKADVDMNKRAGELTAAELDNIMTVVANPRQFKIPDWFLNRKKDYKDGKYSQVVSNSLDMKLRDDLERLKKIRNHRGLRHYWGLRVRGQHTKTTGRRGKTVGVSKKR

SEQ ID NO: 6566 - protein, 152 aa, Unknown
  Sequence found in Organisms: Citrus clementina, Citrus sinensis
MSLVANEDFQHILRVLNTNVDGKQKIMFALTSIKGIGRRLANIVCKKADVDMNKRAGELSAAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6567 - protein, 152 aa, Cucurbita pepo
MSLVANEDFQHILRVLNTNVDGKQKIMFALTSIKGIGRRLANMVCKKADVDMNKRAGELTAAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6568 - protein, 152 aa, Cycas rumphii
MSLIANEDFQHILRVLNTNVDGRQKIMFALTSIKGVGRRFANLVCKKADVDMNKRAGELSASELENLMVIIGNPRQFKIPDWFLNRKKDHKDGRYSQVVSNALDMKLRDDLERLKKIRNHRGLRHYWGLRVRGQHTKTTGRRGKTVGVSKKR

SEQ ID NO: 6569 - protein, 152 aa, Cycas rumphii
MSLIANEDFQHILRVLNTNVDGRQNIMFALTSIKGVGRRFANLVCKKADIDMNKRAGELSANELENLMVIIGNPRQFKIPDWFLNRKKDHKDGRYSQVVSNALDMKLRDDLERLKKIRNHRGLRHYWGLRVRGQHTKTTGRRGKTVGVSKKR

SEQ ID NO: 6570 - protein, 152 aa, Solanum melongena
MSLVANEDFQHILRVQNTNVDGKQKIMFALTSIKGIGRRFANIACKKADIDMNKRAGELTAAELDSIMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6571 - protein, 152 aa, Solanum melongena
MALVANEDFQHILRVQNTNVDGKQKIMFAMTSIKGIGRRFANIACKKADIDMNKRAGELSAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6572 - protein, 152 aa, Eucalyptus grandis
MSLVANEEFQHILRVLNTNVDGKQKIMFALTSIKGIGRRFANIVCKKADVDMNKRAGELSAAELDNLMVIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6573 - protein, 152 aa, Euonymus alatus
MSLVANEDFQHILRVLNTNVDGKDKIMFALTSIKGIGRRFANIVCKKADVDMNKRAGELTAAELENLMAVVGNPRQYKIPDWFLNRQKDYKDGKYSQVVSNALDMKLRDDLERLKKIRNHRGLRHYWGLRVRGQHTKTTGRRGKTVGVSKKR

SEQ ID NO: 6574 - protein, 152 aa, Fagopyrum esculentum
MSLVANEDFQHILRVLNTNVDGKQKIMFALTSIKGIGRRFSNIVCKKGDVDMNKRAGELSNAEIDNLMSIVANPRQFKIPDWFLNRKKDYKDGRYSQVVSNGLDMKLRDDLERLKKIRNHRGLRHYWGLRVRGQHTKTTGRRGKTVGVSKKR

SEQ ID NO: 6575 - protein, 152 aa, Festuca arundinacea
MSLISGEEFQHILRVQNTNVDGKQKIMFALTAIKGIGRRYSNIACKKADIDMNKRAGELTTEELERVMHVVQNPRSFKVPDWFLNRKKDYKDGKFSQVTSNAVDMKLRDDLERLKKIRNHRGLRHYWGVRVRGQHTKTTGRRGKTVGVSKKR

SEQ ID NO: 6576 - protein, 152 aa, Flaveria ramosissima
MSLVANEDFQHILRVQNTNVDGKQKIMFAMTSIKGIGRRFANIVCKKADVDMNKRAGELSTAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6577 - protein, 152 aa, Panax ginseng
MSLVANEDFQHILRIQNTNVDGKQKIMFALTSIKGIGRRFANIVCKKADVDMNKRAGELSAAEIDSLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6578 - protein, 152 aa, Carpinus betulus
MSLVANEEFQHILRVLNTNVDGKQKIMFALTSIKGIGRRLANIVCKKADVDMNKRAGELTAAELDNLMVIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6579 - protein, 152 aa, Jatropha curcas
MSLVANEEFQHILRVLNTNVDGKQKIMFALTSIKGIGRRFANIVCKKADVDMNKRAGELSAEELDKLMVIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6580 - protein, 152 aa, Actinidia deliciosa
MSLVANEEFQHILRVQNTNVDGKQKIMFALTSIKGIGRRFANIVCKKADVDMNKRAGELSSQELDNLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6581 - protein, 152 aa, Lactuca sativa
MSLVANEEFQHILRIQNTNVDGKQKIMFAMTSIKGIGRRFSNIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6582 - protein, 152 aa, Tropaeolum majus
MSLVANEEFQHILRVLNTNVDGKKKIMFAMTSIKGIGRRFANIVCKKADVDMNKRAGELTAAELDNLMVIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6583 - protein, 152 aa, Capsicum annuum
MSLVANEDFQHILRVQNTNVDGKQKIMFAMTSIKGIGRRFANIACKKADIDMSKRAGELSAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6584 - protein, 152 aa, Capsicum annuum
MSLVANEDFQHILRVQNTNVDGKQKIMFALTSIKGIGRRFANIACKKADIDMNKRAGELTAAELDSVMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6585 - protein, 152 aa, Lippia dulcis
MSLVANEDFQHILRVQNTNVDGKQKIMFAMTSIKGIGRRFANIVCKKADVDMNKRAGELSAAEIDGLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6586 - protein, 152 aa, Lippia dulcis
MSLVANEDFQHILRVQNTNVDGKQKIMFAMTSIKGIGRRFANIICKKADVDMNKRAGELSAAEIDGLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6587 - protein, 152 aa, Plantago ovata
MSLVANEEFQHILRVQNTNVDGKQKIMFALTSIKGIGRRFANIVCKKADIDMNKRAGELSNAEIDSLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6588 - protein, 152 aa, Populus trichocarpa
MALVANEEFQHILRVLNTNVDGKQKIMFALTSIKGIGRRFANIVCKKADVDMNKRAGELSAEELDKLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6589 - protein, 152 aa, Solanum tuberosum
MSLIANEEFQHILRVQNTNVDGKQKIMFALTSIKGIGRRFANIACKKADIDMNKRAGELTAAELDSVMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6590 - protein, 152 aa, Rhizophora mangle
MSLVANEDFQHILRVLNTNVDGKQKIMFALTSIKGIGRRLANIVCKKADVDMNKRAGELSAEELDKLMVIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6591 - protein, 152 aa, Sarracenia psittacina
MSLVSNEDFQHILRVQNTNVDGKQKIMFALTSIKGIGRRFANIVCKKADIDMNKRAGELSNQELDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6592 - protein, 152 aa, Senecio madagascariensis
MSLVANEDFQHILRVQNTNVDGKQKIMFAMTSIKGIGRRFANIVCKKADIDMNKRAGELSNADIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6593 - protein, 152 aa, Sesamum indicum
MSLVANEDFQHILRVQNTNVDGKQKIMFALTSIKGIGRRFANIVCKKADIDMNKRAGELSNAEIDSLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6594 - protein, 152 aa, Solanum phureja
MSLVANEEFQHILRVQNTNVDGKQKIMFAMTSIKGIGRRFANIACKKADIDMSKRAGELTAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6595 - protein, 152 aa, Camellia sinensis
MSLVANEEFQHILRVQNTNVDGKQKIMFAMTSIKGIGRRFANIVCKKADVDMNKRAGELSNQEIDNLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6596 - protein, 152 aa, Nicotiana tabacum
MSLVANEEFQHILRVQNTNVDGKQKIMFAMTSIKGIGRRFANIACKKADIDMNKRAGELSSAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6597 - protein, 152 aa, Triphysaria pusilla
MSLVANEEFQHILRIQNTNVDGKQKIMFAMTSIKGIGRRFSNIVCKKADVDMNKRAGELSNAEIDGLMAIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6598 - protein, 179 aa, Zostera marina
MALVANEDFQHILRVLNTNVDGKRKIMYALTSIKGIGRRFANIVCKKADVDMNKRAGEISAEELETLMTIVANPRQFKIPDWFLNRKKDYKDGRFSQVVSNALDMKLRDDLERLKKIRNHRGLRHYWGLRVRGQHTKTTGRRGKTVGVSKSVDYSFMCGFLTFVLCLSLLSKILDYVIF

SEQ ID NO: 6599 - protein, 122 aa, Cicer arietinum
MSLVANEEFQHILRVLNTNVDGKQKIMFALTSIKGIGRRFANICCKKADVDMNKRAGELSAAELDNLMTVVANPRQFKIPDWFLNRKKDYKDGKFSQVVSNSLDMKLRDDLERLKKIETTVV

SEQ ID NO: 6600 - protein, 152 aa, Unknown
  Sequence found in Organisms: Solanum melongena, Nicotiana benthamiana, Nicotiana tabacum
MSLVANEEFQHILRVQNTNVDGKQKIMFAMTSIKGIGRRFANIACKKADIDMSKRAGELSAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6601 - protein, 132 aa, Panicum virgatum
MASRRSCRAHLHQGVSGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 6602 - protein, 126 aa, Ambrosia trifida
MFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6603 - protein, 148 aa, Persea americana
ANEEFQHILRVLNTNVDGKQKIMFALTSIKGIGRRFANLVCKKADVDMNKRAGELSAAELESLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6604 - protein, 152 aa, Unknown
  Sequence found in Organisms: Cannabis sativa, Humulus lupulus
MSLVANEEFQHILRVLNTNVDGKQKIMFALTSIKGIGRRFANLVCKKADVDMNKRAGELSAQELDNLMVIVANPRQFKIPDWFLNRKKDYKDGKYSQVVSNALDMKLRDDLERLKKIRNHRGLRHYWGLRVRGQHTKTTGRRGKTVGVSKKR

SEQ ID NO: 6605 - protein, 152 aa, Cirsium arvense
MSLVANEDFQHILRVQNTNVDGKQKIMFAMTSIKGIGRRFANIVCKKADVDMNKRAGELSNAEIDNLMTIVANPRQFKIPDWFFNRKKDYKDGKYSQVTSNALDMKLRDDLERLKKIRNHRGLRHYWGLRVRGQHTKTTGRRGKTVGVSKKR

SEQ ID NO: 6606 - protein, 83 aa, Cucurbita pepo
MSLVANEDFQHILRVLNTNVDGKQKIMFALTSIKGIGRRLANMVCKKADVDMNKRAGELTAAELDNLMVVVANPDSSKFLIGF

SEQ ID NO: 6607 - protein, 83 aa, Cucurbita pepo
MSLVANEDFQHILRVLNTNVDGKQKIMFALTSIKGIGRRLANMVCKKADVDMNKRAGELTAAELDNLMVVVANPRQFKIPDWF

SEQ ID NO: 6608 - protein, 152 aa, Cycas rumphii
  misc_feature (88)..(88): Xaa can be any naturally occurring amino acid
  misc_feature (108)..(108): Xaa can be any naturally occurring amino acid
MSLIANEDFQHILRVLNTNVDGRQKIMFALTSIKGVGRRFANLVCKKADVDMNKRAGELSSTELENLMVIVGNPRQFKIPDWFLNRKXDHKDGRYSQVVSNALDMKLXDDLERLKKIRNHRGLRHYWGLRVRGQHTKTTGRRGKTVGVSKKR

SEQ ID NO: 6609 - protein, 152 aa, Fagopyrum esculentum
MSLVANEDFQHILRVLNTNVDGKQRIMYALTSIKGIGRRFSNIVCKKADVDMNKRAGELSNADIDNLMTIVANPRQFKIPDWFLNRKKDYKDGRYSQVVSNGLDMKLRDDLERLKKIRNHRGLRHYWGLRVRGQHTKTTGRRGKTVGVSKKR

SEQ ID NO: 6610 - protein, 152 aa, Flaveria ramosissima
MSLVSNEDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6611 - protein, 178 aa, Flaveria ramosissima
MSLVANEDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVVCPRRDKFSMPSKTSYFCGFDVLKNLYCYHQF

SEQ ID NO: 6612 - protein, 213 aa, Flaveria ramosissima
MSLVANEDFRHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYVGSPSAWTAHQNHWSVRGKTVGVSKKRLSFSMPYEKQAYFCGFDVLKNSLLLSSNFVTFWLSYLFCGYSCTFGFHVSYCFFNGCFDE

SEQ ID NO: 6613 - protein, 152 aa, Flaveria ramosissima
MSLVANEDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGETVGVSKKR

SEQ ID NO: 6614 - protein, 83 aa, Flaveria ramosissima
MSLVANEDFQHILRVQNTNVDGKQKIMFAMTSIKGIGRRFANIVCKKADVDMNKRAGELSSAEIDNLMTIVANPRQFKIPDGF

SEQ ID NO: 6615 - protein, 152 aa, Guizotia abyssinica
MSLVANEDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLEKIRNHRGLRHYWGLRVRGQHTKTTGRRGKTVGVSKKR

SEQ ID NO: 6616 - protein, 152 aa, Lactuca sativa
MSLVANEEFQHILRVQNTNVDGKQKIMFAMTSIKGIGRRFANIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6617 - protein, 152 aa, Lactuca sativa
MSLVANEDFQHILRVQNTNVDGKQKIMFAVTSIKGIGRRFANIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6618 - protein, 152 aa, Lolium multiflorum
MSLISGEEFQHILRVQNTNVDGKQKIMFALTAIKGIGRRYSNIACKKADIDMNKRAGELTTEELDRVMHVVQNPRSFKVPDWFLNRKKDYKDGKFSQVTSNAVDMKLRDDLERLKKIRNHRGLRHYWGVRVRGQHTKTTGRRGKTVGVSKKR

SEQ ID NO: 6619 - protein, 152 aa, Lotus japonicus
MSLVANEDFQHILRVLNTNVDGKQKIMFALTSIKGIGRRFANICCKKADVDMNKRAGELSAAELDNVMTVVANPKQFKIPDWFLNRKKDYKDGKYHQVVSNALDMKLRDDLERLKKIRNHRGLRHYWGLRVRGQHTKTTGRRGKTVGVSKKR

SEQ ID NO: 6620 - protein, 152 aa, Marchantia polymorpha
MSLIAGEEFQHILRVLNTNVDGRQKIMFALTSIKGVGRRFANLVCKKADVDMSKRAGELSAAELENLMVIVGNPRQFKIPDWFLNRKKDHKDGRYSQVVSNALDMKLRDDLERLKKIRNHRGLRHYWGLRVRGQHTKTTGRRGRTVGVSKKR

SEQ ID NO: 6621 - protein, 152 aa, Mimulus guttatus
MSLVANEEFQHILRIQNTNVDGKQKIMFAMTSIKGIGRRFANIVCKKADVDMNKRAGELSNAEIDSLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6622 - protein, 152 aa, Tropaeolum majus
MSLVANEEFQHILRVLNTNVDGKKNIMFAMTSIKGIGRRFANIVCKKADVDMTKRAGELTAAELDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6623 - protein, 152 aa, Unknown
  Sequence found in Organisms: Solanum lycopersicum, Nicotiana benthamiana, Petunia hybrida, Solanum phureja, Nicotiana tabacum
MSLVANEEFQHILRVQNTNVDGKQKIMFALTSIKGIGRRFANIACKKADIDMNKRAGELTAAELDSVMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6624 - protein, 152 aa, Physcomitrella patens
MSLVAGEEFQHILRVLNTNVDGRQKIMFALTSIKGVGRRFANLVCKKADVDMSKRAGELSAAELENLMVIVANPRQFKIPDWFLNRKKDHKDGRYSQVVSNALDMKLRDDLERLKKIRNHRGLRHYWGLRVRGQHTKTTGRRGRTVGVSKKR

SEQ ID NO: 6625 - protein, 152 aa, Podocarpus macrophillus
MSLIANEEFQHILRVLNTNVDGRQKIMFALTSIKGIGRRFANIVCKKADVDMNKRAGELSAQELEQLMTIVASPRQFKIPDWFLNRKKDHKDGKYSQVVANALDMKLRDDLERLKKIRNHRGLRHYWGLRVRGQHTKTTGRRGKTVGVSKKR

SEQ ID NO: 6626 - protein, 152 aa, Primula obconica
MSLVANEEFQHILRVQNTNVDGKQKIMFAMTSIKGIGRRFANIVCKKADVDMNKRAGELSSQEIDNLMTIVANPRQFNIPDWFLNRKKDYKDGKFSQVTSNALDMKLRDDLERLKKIRNHRGLRHYWGLRVRGQHTKTTGRRGKTVGVSKKR

SEQ ID NO: 6627 - protein, 152 aa, Pteridium aquilinum
MSLVANEEFQHILRVLNTNVDGRQKIMFALTSIKGIGRRFANLICKKADVDMNKRAGELSAQELENLMFIVANPRQFKIPDWFLNRKKDYKDGRFSQVVSNALDMKLRDDLERLKKIRNHRGLRHYWGLRVRGQHTKTTGRRGRTVGVSKKR

SEQ ID NO: 6628 - protein, 152 aa, Unknown
  Sequence found in Organisms: Rosa hybrid cultivar, Fragaria vesca
MSLVANEEFQHILRVLNTNVDGKQKIMFAMTSIKGIGRRLANIVCKKADVDMNKRAGELSAAEIDNLMTIVGNPRQFKIPDWFLNRKKDYKDGRYSQVVANALDMKLRDDLERLKKIRNHRGLRHYWGLRVRGQHTKTTGRRGKTVGVSKKR

SEQ ID NO: 6629 - protein, 152 aa, Sarracenia psittacina
MSLVANEEFQHILRVQNTNVDGKQKIMFALTSIKGIGRRFANIACKKADIDMNKRAGELSSQELDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6630 - protein, 152 aa, Sarracenia psittacina
MSLVSNEDFQHILRVQNTNVDGKQKIMFALTSIKGIGRRFANIVCKKADVDMNKRAGELSNQELDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6631 - protein, 152 aa, Sciadopitys verticillata
MSLIANEEFQHILRVLNTNVDGRQKIMFALTSIKGIGRRFANIVCKKADVDMSKRAGELSAQELENLMVIVANPRQFKIPDWFLNRKKDHKDGRYSQVVANALDMKLRDDLERLKKIRNHRGLRHYWGLRVRGQHTKTTGRRGKTVGVSKKR

SEQ ID NO: 6632 - protein, 152 aa, Senecio madagascariensis
MSLVANEEFQHILRVQNTNVDGKQKIMFAMTSIKGIGRRFANIVCKKADIDMNKRAGELSNADIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6633 - protein, 152 aa, Selaginella moellendorffii
MSLVSNEEFQHILRVLNTNVDGRQKIMFALTSIKGIGRRFANIVCKKADVDMNKRAGELTAAELENLMVIVANPRQFKIPDWFLNRKKDYKDGRYSQVVANALDMKLRDDLERLKKIRNHRGLRHYWGLRVRGQHTKTTGRRGRTVGVSKKR

SEQ ID NO: 6634 - protein, 152 aa, Helianthus annuus
MSLVANEEFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6635 - protein, 126 aa, Unknown
  Sequence found in Organisms: Taraxacum officinale, Tragopogon dubius
MFAMTSIKGIGRRFANIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6636 - protein, 152 aa, Triphysaria pusilla
MSLVANEEFQHILRVQNTNVDGKQKIMFAMTSIKGIGRRFANIVCKKADVDMNKRAGELSNAEIDGLMAIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6637 - protein, 152 aa, Utricularia gibba
MSLVANEDFQHILRVQNTNVDGKQKIMFALTSIKGIGRRFANIVCKKADVDMNKRAGELSAAELDNLMVIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6638 - protein, 101 aa, Papaver somniferum
MNKRAGELSAAELENLMTIVANPRQFKIPDWFLNRKKDYKDGRYSQVVSNALDMKLRDDLERLKKIRNHRGLRHYWGLRVRGQHTKTTGRRGKTVGVSKKR

SEQ ID NO: 6639 - protein, 86 aa, Primula obconica
MTIVRQPTPIQHSRLVSEQEERLQGWVNFLRSHPIALDMKLRDDLERLKKIRNHRGLRHYWGLRVRGQHTKTTGRRGKTVGVSKKR

SEQ ID NO: 6640 - protein, 126 aa, Euphorbia esula
MFALTSIKGIGRRLANIVCKKADVDMNKRAGELTAAELDNLMVIVANPRQFKIPHWFLNRQKDYKDGKYSQVVSNALDMKLRDDLERLKKIRNHRGLRHYWGLRVRGQHTKTTGRRGKTVGVSKKR

SEQ ID NO: 6641 - protein, 152 aa, Unknown [sequence omitted]

SEQ ID NO: 6642 - protein, 152 aa, Vaccinium corymbosum
MSLVANEEFQHILRVQNTNVDGKQKIMFALTSIKGIGRRFANIVCKKADVDMNKRAGELSNQEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6643 - protein, 152 aa, Bupleurum chinense
MSLVANEDFQHILRIQYTNVDGKQKIMFALTSIKGIGRRFANIVCKKADVDMNKRAGELSSAEIDSLMTIVANPRQFSIPDWFLNRKKDYKDGKFSQVTSNALDMKLRDDLERLKKIRNHRGLRHYWGLRVRGQHTKTTGRRGKTVGVSKKR

SEQ ID NO: 6644 - protein, 152 aa, Euphorbia peplus
MSLVANEEFQHILRVLNTNVDGKQKIMFALTSIKGIGRRLANIVCKKADVDMNKRAGELTAAELDNLMVIVANPRQFKIPHWFLNRQKDYKDGKYSQVVSNALDMKLRDDLERLKKIRNHRGLRHYWGLRVRGQHTKTTGRRGKTVGVSKKR

SEQ ID NO: 6645 - protein, 152 aa, Euphorbia peplus
MSLVANEEFQHILRVLNTNVDCKQKIMFALTSIKGIGRRFANIVCKKADVDMNKRAGELSAEELDKLMVIVANPRQFKIPDWFLNRQKDYKDGKYHQVVSNALDMKLRDDLERLKKIRNHRGLRHYWGLRVRGQHTKTTGRRGKTVGVSKKR

SEQ ID NO: 6646 - protein, 152 aa, Unknown
  Sequence found in Organisms: Euphorbia peplus, Euphorbia esula
MSLVANEEFQHILRVLNTNVDGKQKIMFALTSIKGIGRRLANIVCKKADVDMNKRAGELSSEELDKLMVIVANPRQFKIPDWFLNRQKDYKDGKYHQVVSNALDMKLRDDLERLKKIRNHRGLRHYWGLRVRGQHTKTTGRRGKTVGVSKKR

SEQ ID NO: 6647 - protein, 152 aa, Adiantum capillus-veneris
MSLVANEEFQHILRVLNTNVDGRQKIMFALTSIKGIGRRFANLICKKADVDMNKRAGELSAQELENLMFIVANPRQFKIPDWFLNRKKDYKDGRFSQVVSNQLDMKLRDDLERLKKIRNHRGLRHYWGLRVRGQHTKTTGRRGRTVGVSKKR

SEQ ID NO: 6648 - protein, 148 aa, Fraxinus spp
ANEDFQHILRVQNTNVDGKQKIMFALTSIKGIGRRFANIVCKKADIDMNKRAGELSAAEIDSLMTIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6649 - protein, 152 aa, Lotus japonicus
MSLVANEEFQHILRVLNTNVDGKQKIMFALTSIKGIGRRFANICCKKADVDMNKRAGELSAAELDNVMTVVANPKQFKIPDWFLNRKKDYKDGKYHQVVSNALDMKLRDDLERLKKIRNHRGLRHYWGLRVRGQHTKTTGRRGKTVGVSKKR

SEQ ID NO: 6650 - protein, 152 aa, Tropaeolum majus
MSLVANEDFQHILRVLNTNVDGKKNIMFALTSIKGIGRRFANIVCKKADVDMTKRAGELSAAELENLMVIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6651 - protein, 152 aa, Nicotiana benthamiana
  misc_feature (52)..(52): Xaa can be any naturally occurring amino acid
MSLVANEEFQHILRVQNTNVVGKQKIMFAMTSIKGIGRRFANIACKKADIDXNKRAGELSAAELDSLMVVVANPRQFKIPDWFLNRQKDYKDGKFSQVTSNALDMKLRDDLERLKKIRNHRGLRHYWGLRVRGQHTKTTGRRGKTVGVSKKR

SEQ ID NO: 6652 - protein, 152 aa, Allium cepa
MSLVAGEDFQHILRVQNTNVDGKQKIMFALTSIKGIGRRFANIVCKKADIDMNRRAGELSNAEIDQLMNIVANPRQFKIPDWFLNRQKDYKDGRYTQVTSNALDMKLRDDLERLKKIRNHRGLRHYWGLRVRGQHTKTTGRRGKTVGVSKKR

SEQ ID NO: 6653 - protein, 152 aa, Allium cepa
MSLVAGEDFQHILRVQNTNVDGKQKIMFALTSIKGIGRRFANIVCKKADIDMNRRAGELSNAEIDQLMTIVSNPRQFKIPDWFLNRQKDYKDGRYTQVTSNALDMKLRDDLERLKKIRNHRGLRHYWGLRVRGQHTKTTGRRGKTVGVSKKR

SEQ ID NO: 6654 - protein, 152 aa, Orobanche aegyptiaca
MSLVANEEFQHILRVQNTNVDGKQKIMFALTSIKGIGRRFANIVCKKADVDMNKRAGELSNAEIDNLMVIVANPRQFKIPDWFLNRKKDYKDGKFSQVTSNALDMKLRDDLERLKKIRNHRGLRHYWGLRVRGQHTKTTGRRGKTVGVSKKR

SEQ ID NO: 6655 - protein, 152 aa, Orobanche aegyptiaca
MSLVANEEFQHILRVQNTNVDGKQKIMFALTSIKGIGRRFANIVCKKADVDMNKRAGELSAAEIENLMVIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6656 - protein, 152 aa, Carica papaya
MSLVANEDFQHILRVLNTNVDGKQKIMFALTSIKGIGRRFANVVCKKADVDMNKRAGELSAAELENLMSIVANPRQYKIPDWFLNRQKDYKDGKYSQLVSNALDMKLRDDLERLKKIRNHRGLRHYWGLRVRGQHTKTTGRRGKTVGVSKKR

SEQ ID NO: 6657 - protein, 152 aa, Abies balsamea
MSLIANEEFQHILRVLNTNVDGRQKIMFALTSIKGIGRRLANLVCKKADVDMNKRAGELSALELENLMTIVANPKQFKIPEWFLNRQKDIKDGRTSQVVSNALDMKLRDDLERLKKIRNHRGLRHYWGLRVRGQHTKTTGRRGKTVGVSKKR

SEQ ID NO: 6658 - protein, 152 aa, Amsonia hubrichtii
MSLVANEDFQHILRIQNTNVDGKQKVMFALTSIKGIGRRFANIMCKKADVDMNKRAGELSAQEIDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6659 - protein, 149 aa, Arnica chamissonis
MSLVANEDFQHILRVQNTNVDGKQKIMFAMTSIKGIGRRFANIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVS

SEQ ID NO: 6660 - protein, 152 aa, Cedrus atlantica
MSLVANEDFQHILRVLNTNVDGRQKIMFALTSIKGIGRRFANIVCKKADVDMNKRAGELSAAELEGLMTIVNNPKQFKIPEWFLNRQKDYKDGRTSQLVSNALDMRLRDDLERLKKIRNHRGLRHYWGLRVRGQHTKTTGRRGKTVGVSKKR

SEQ ID NO: 6661 - protein, 152 aa, Cedrus atlantica
MSLIANEDFQHILRVLNTNVDGRQKIMFALTSIKGIGRRLANLVCKKADVDMNKRAGELSALELENLMIIVGNPKQFKIPDWFLNRQKDIKDGRTSQVVSNALDMKLRDDLERLKKIRNHRGLRHYWGLRVRGQHTKTTGRRGKTVGVSKKR

SEQ ID NO: 6662 - protein, 152 aa, Gnetum gnemon
MSLVANEDFQHILRVLNTNVDGRQKIMFALTSIKGIGRRFANIVCKKGDVDMNKRAGELSAAEIENLMVIVANPRQFKIPDWFLNRKKDIKDGRYSQVVANALDMKLRDDLERLKKIRNHRGLRHHWGLRVRGQHTKTTGRRGKTVGVSKKR

SEQ ID NO: 6663 - protein, 152 aa, Gnetum gnemon
MSLVASEDFQHILRVLNTNVDGRQKIMFALTSIKGIGRRFANIVCKKGDVDMSKRAGELSAAELENLMVIVANPRQFKIPDWFLNRKKDIKDGRYSQVVANALDMKLRDDLERLKKIRNHRGLRHHWGLRVRGQHTKTTGRRGKTVGVSKKR

SEQ ID NO: 6664 - protein, 152 aa, Guizotia abyssinica
MSLVANEDFQHILRVQNTNVDGKQKIMFAMTSIKGIGRRFANIVCKKADVDMNKRAGELSSAEIDNLMTIGANPRQFKIPDWFLNRKKDYKDGKYSQVTSNTLDMKLRDDLERLKKIRNHRGPRHYWGLRVRGQHTKTTGRRGKTVGVSKKR

SEQ ID NO: 6665 - protein, 152 aa, Podocarpus macrophillus
MSLVANEEFQHILRVLNTNVDGRQKIMFALTSIKGIGRRFANIVCKKADVDMNKRAGELSAAELETLMGIVASPRQFKIPDWFLNRKKDHKDGKYSQVVANALDMKLRDDLERLKKIRNHRGLRHYWGLRVRGQHTKTTGRRGKTVGVSKKR

SEQ ID NO: 6666 - protein, 152 aa, Picea glauca
MSLIANEEFQHILRVLNTNVDGRQKIMFALTSIKGIGRRLANLVCKKADVDMNKRAGELTALELENLMIIVANPKQFKIPDWFLNRQKDIKDGRTTQVVSNALDMKLRDDLERLKKIRNHRGLRHYWGLRVRGQHTKTTGRRGKTVGVSKKR

SEQ ID NO: 6667 - protein, 152 aa, Picea glauca
MSLIANEEFQHILRALNTNVDGRQKIMFALTSIKGIGRRLANLVCKKADVDMNKRAGELTALELENLMIIVANPKQFKIPDWFLNRQKDIKDGRTTQVVSNALDMKLRDDLERLKKIRNHRGLRHYWGLRVRGQHTKTTGRRGKTVGVSKKR

SEQ ID NO: 6668 - protein, 152 aa, Fragaria vesca
MSLVANEEFQHILRVMNTNVDGKQKIMFALTSIKGIGRRLANIVCKKADVDMNKRAGELSAQEIENLMHIVANPRQFKIPDWFLNRKKDYKDGKYSQVVANALDMKLRDDLERLKKIRNHRGLRHYWGLRVRGQHTKTTGRRGKTVGVSKKR

SEQ ID NO: 6669 - protein, 153 aa, Flaveria ramosissima
MSLVANGDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVGVSKSDE

SEQ ID NO: 6670 - protein, 276 aa, Brassica juncea
VLRCLGYIQPSHLPFTELLKFILFANFSIVGMNVSLMWNSVGFYQIAKLSMIPVACLLEVVFDKIRYSRDTKLSIGLVLVGVGVCTVTDVSVNTKGFVAAFVAVWSTALQQYYVHYLQRKYSLTSFNLLGHTAPAQAATLLIVGPFLDFWLTEKRVDMYDYNVVSLMFITLSCTIAIGTNLSQFICIGRFTAVSFQVLGHMKTILVLIMGFFFFDRDGLNLHVVIGMIIAVLGMIWYGNASSKPGGKEKKSYSLPTTRQQKHGDDSDSDERPRLKA

SEQ ID NO: 6671 - protein, 101 aa, Picea glauca
MNKRAGELTALELENLMIIVANPKQFKIPDWFLNRQKDIKDGRTTQVVSNALDMKLRDDLERLKKIRNHRGLRHYWGLRVRGQHTKTTGRRGKTVGVSKKR

SEQ ID NO: 6672 - protein, 152 aa, Unknown
  Sequence found in Organisms: Brassica napus, Brassica juncea, Brassica oleracea, Brassica rapa, Raphanus sativus, Eutrema parvulum
MSLVANEEFQHILRVLNTNVDGKQKIMFALTSIKGIGRRLANIVCKKADVDMNKRAGELSAAEIDNLMTIVANPKQYKIPDWFLNRQKDYKDGKYSQVVSNALDMKLRDDLERLKKIRNHRGLRHYWGLRVRGQHTKTTGRRGKTVGVSKKR

SEQ ID NO: 6673 - protein, 152 aa, Bruguiera gymnorhiza
  misc_feature (145)..(146): Xaa can be any naturally occurring amino acid
  misc_feature (148)..(148): Xaa can be any naturally occurring amino acid
  misc_feature (152)..(152): Xaa can be any naturally occurring amino acid
MSLVANEDFQHILRVLNTNVDGKQKIMFALTSIKGIGRRFANIVCKKADVDMNKRAGELSAEELDKLMVIVANPRQFKIPDWFLNRQKDYKDGKYSQVVSNALDMKLRDDLERLKKIRNHRGLRHYWGVRVRGQHTKTTGRRGKXXGXSKKX

SEQ ID NO: 6674 - protein, 148 aa, Cirsium arvense
MSLVANEDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVGV

SEQ ID NO: 6675 - protein, 147 aa, Flaveria ramosissima
NEDFQHILRVQNTNVDGKQKIMFAMTSIKGIGRRFANIVCKKADVDMNKRAGELSSAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6676 - protein, 152 aa, Pinus pinaster
MSLIANEEFQHILRVLNTNVDGRQKIMFALTSIKGIGRRLANLVCKKADVDMNKRAGELSALELENLMIIVANPKQFKIPDWFLNRQKDIKDGRTTQVVSNALDMKLRDDLERLKKIRNHRGLRHYWGLRVRGQHTKTTGRRGKTVGVSKKR

SEQ ID NO: 6677 - protein, 152 aa, Pseudotsuga menziesii
MSLIANEEFQHILRVLNTNVDGRQKIMFALTSIKGIGRRLANLVCKKADVDMNKRAGELSAQELESLMIIVANPKQFKIPDWFLNRQKDIKDGRTSQVVSNGLDMKLRDDLERLKKIRNHRGLRHYWGLRVRGQHTKTTGRRGKTVGVSKKR

SEQ ID NO: 6678 - protein, 152 aa, Rosa hybrid cultivar
MSLVANEEFQHILRVLNTNVDGKQKIMFALTSIKGIGRRLANIVCKKADVDMNKRAGELSGQEIDNLMHIVSNPRQFKIPDWFLNRKKDYKDGKYSQVVANALDMKLRDDLERLKKIRNHRGLRHYWGLRVRGQHTKTTGRRGKTVGVSKKR

SEQ ID NO: 6679 - protein, 152 aa, Tabernaemontana elegans
MSVIVNEDFQHILRIQNTNVDGKQKVMFALTSIKGIGRRFANIICKKADVDMNKRAGELSAQEIDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6680 - protein, 151 aa, Eutrema parvulum
SLVAGEEFQHILRVLNTNVDGKQKIMFALTSIKGIGRRLANIVCKKADVDMNKRAGELSAAEIDNLMTIVANPKQYKIPDWFLNRQKDYKDGKYSQVVSNALDMKLRDDLERLKKIRNHRGLRHYWGLRVRGQHTKTTGRRGKTVGVSKKR

SEQ ID NO: 6681 - protein, 152 aa, Vinca minor
MSLVANEEFQHILRIQNTNVDGKQKVMFALTSIKGIGRRFANIICKKADVDMNKRAGELSAAEIDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6682 - protein, 152 aa, Vinca minor
MSLVANEEFQHILRIQNTNVDGKQKVMFALTSIKGIGRRFANIICKKADVDMNKRAGELSSAEIDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6683 - protein, 152 aa, Vinca minor
MSLVANEEFQHILRIQNTNVDGKQKVMFALTSIKGIGRRFANIICKKADVDMNKRAGELSSQEIDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6684 - protein, 152 aa, Amsonia hubrichtii
MALVANEDFQHILRIQNTNVDGKQKVMFALTSIKGIGRRFANIICKKADVDMNKRAGELSAAEIDNLMTIVSNPRQFKIPDWFLNRQKDYKDGKYSQVVSNALDMKLRDDLERLKKIRNHRGLRHYWGLRVRGQHTKTTGRRGKTVGVSKKR

SEQ ID NO: 6685 - protein, 152 aa, Unknown
  Sequence found in Organisms: Brassica napus, Brassica oleracea
MSLVANDEFQHILRVLNTNVDGKQKIMFALTSIKGIGRRLANIVCKKADVDMNKRAGELSAAEIDNLMTIVANPKQYKIPDWFLNRQKDYKDGKYSQVVSNALDMKLRDDLERLKKIRNHRGLRHYWGLRVRGQHTKTTGRRGKTVGVSKKR

SEQ ID NO: 6686 - protein, 148 aa, Bupleurum chinense
MSLVANEDFQHILRIQNTNVDGKQKIMFALTSIKGIGRRFANIVCKKADVDMNKRAGELSAAEIDSLMTIVANPRQFKIPDWFLNRKKDYKDGKFSQVTSNALDMKLRDDLERLKKIRNHRGLRHYWGLRVRGQHTRTTGRRGKTVGV

SEQ ID NO: 6687 - protein, 152 aa, Coffea canephora
MALVANEEFQHILRIQNTNVDGKQKVMFALTSIKGIGRRFANIICKKADVDMNKRAGELSAAEIDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6688 - protein, 152 aa, Unknown
  Sequence found in Organisms: Pinus pinaster, Pinus taeda
MSLVANEEFQHILRVLNTNVDGRQKIMFALTSIKGIGRRFANLVCKKADVDMNKRAGELSAAELENLMTIVSNPKQFKIPDWFLNRQKDYKDGRTTQLVSNALDMRLRDDLERLKKIRNHRGLRHYWGLRVRGQHTKTTGRRGKTVGVSKKR

SEQ ID NO: 6689 - protein, 152 aa, Allium cepa
MALVANEDFQHILRVQNTNVDGKQKIMFALTSIKGIGRRFANIVCKKADIDMNRRAGELSNAEIDQLMNIVQNPRQFKIPDWFLNRQKDYKDGRYTQVTSNALDMKLRDDLERLKKIRNHRGLRHYWGLRVRGQHTKTTGRRGKTVGVSKKR

SEQ ID NO: 6690 - protein, 152 aa, Pinus taeda
MSLIANEEFQHILRVLNTNVDGRQKIMFALTSIKGIGRRLANLVCKKADVDMNKRAGELSALELENLMIIVANPKQFKIPDWFLNRQKDIKDGRTTQVVSNGLDMKLRDDLERLKKIRNHRGLRHYWGLRVRGQHTKTTGRRGKTVGVSKKR

SEQ ID NO: 6691 - protein, 152 aa, Helianthus annuus
MSLDANEDFQHILRVPNTNVDRQQKIMFAMTSIKGIGRRFANIVCKKADVDMNKRAGELSSAEIDNLMTIVANPRQFKIPDRVLNRKKDYKDGKYSQVTSNALDMKLRNDLERLKKIRNHRGLRHYWGLRVRGQHTKTTGRRGKTVGVSKKR

SEQ ID NO: 6692 - protein, 151 aa, Tabernaemontana elegans
ALVANEDFQHILRIQNTNVDGKQKVMFALTSIKGIGRRFANIICKKADVDMNKRAGELSAAEIDNLMTIVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6693 - protein, 152 aa, Zinnia violacea
MSIAANEDFQHILGVQNTNVDGTQKIMLAMTSIKGIGRRFANIVCKKADVDMNKRAGVLSSAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6694 - protein, 100 aa, Secale cereale
RVRSSSTSCVCLNANVDGKQKIMFALTSIKGVGRRFSNIVCKKADIDMNKRAGELSAEEMDRLMAVVHNPRQFKVPDWFLNRKKDYKDGSSPRSSPTLST

SEQ ID NO: 6695 - protein, 85 aa, Zostera marina
MTIVANPRQFKIPDWFLNRKKDYKDGRFSQVVSNALDMKLRDDLERLKKIRNHRGLRHYWGLRVRGQHTKTTGRRGKTVGVSKKR

SEQ ID NO: 6696 - protein, 161 aa, Nuphar advena
MSLITNEDFQHILRILNTNVDGRQKIMFALTSIKGVGRRFANIACKKADIDMNKRAGELSSAELEQLMVIVANPRQFKIPDWFLNRKKDYKDGRYSQVVSNSLDMKLRDDLERLKKIRNHRGLRHYWGLRVRGQHTKTTGRRGKTVGVSKKRREVLVVLLL

SEQ ID NO: 6697 - protein, 80 aa, Vaccinium corymbosum
MSLVANEEFQHILRVQNTNVDGKQKIMFALTSIKGIGRRFANIVCKKADVDMNKRAGELSNQEIDNLMTIVAKSSPVQNP

SEQ ID NO: 6698 - protein, 126 aa, Tripterygium wilfordii
MFALTSIKGIGRRFANIVCKKADVDMNKRAGELTPAELDNLMVVVANPRQFKIPDWFLNRQKDYKDGKYSQVVSNALDMKLRDDLERLKKIRNHRGLRHYWGLRVRGQHTKTTGRRGKTVGVSKKR

SEQ ID NO: 6699 - protein, 152 aa, Picea glauca
MSLVANEEFQHILRVLNTNVDGRQKIMFALTSIKGIGRRFANLVCKKADVDMNKRAGELSAAELENLMTIVSNPKQFKIPEWFLNRQKDYKDGRTNQLVSNALDMRLRDDLERLKKIRNHRGLRHYWGLRVRGQHTKTTGRRGKTVGVSKKR

SEQ ID NO: 6700 - protein, 152 aa, Eutrema halophilum
MSLVANEEFQHILRVLNTNVDGKQKIMFALTSIKGIGRRMANIVCKKADVDMNKRAGELSAAEIDNLMTIVANPKQYKIPDWFLNRQKDYKDGKYSQVLSNGLDMKLRDDLERLKKIRNHRGLRHYWGLRVRGQHTKTTGRRGKTVGVSKKR

SEQ ID NO: 6701 - protein, 157 aa, Jatropha curcas
MSLVANEEFQHILRVLNTNVDGKQKIMFALTSIKGIGRRFANIVCKKADVDMNKRAGELTAAELDNLMVIVANPRQFKIPDWFLNRQKDYKDGKYSQVVSNALDMKLRDDLERLKKIRNHRGLRHYWGLRVRGQHTKTTGRRGKTVGVSKSGDIIYY

SEQ ID NO: 6702 - protein, 152 aa, Abies balsamea
MSLVANEEFQHILRVLNTNVDGRQKIMFALTSIKGIGRRLANLVCKKADVDMNKRAGELSAAELENLMTIVSNPKQFKIPEWFLNRQKDYKDGRTTQLVSNALDMRLRDDLERLKKIRNHRGLRHYWGLRVRGQHTKTTGRRGKTVGVSKKR

SEQ ID NO: 6703 - protein, 152 aa, Catharanthus roseus
MSLVANEDFQHILRIQNTNVDGKQKVMFALTSIKGIGRRFANIICKKADVDMNKRAGELSAAEIDQLMAIVGDPRQYKIPDWFLNRQKDYKDGKYSQVVSNALDMKLRDDLERLKKIRNHRGLRHYWGLRVRGQHTKTTGRRGKTVGVSKKR

SEQ ID NO: 6704 - protein, 152 aa, Pseudotsuga menziesii
MSLVANEEFQHILRVLNTNVDGRQKIMFALTSIKGIGRRYANLVCKKADVDMNKRAGELTAAELESVMTIVSNPKQFKIPEWFLNRQKDYKDGRTTQLVSNALDMRLRDDLERLKKIRNHRGLRHYWGLRVRGQHTKTTGRRGKTVGVSKKR

SEQ ID NO: 6705 - protein, 145 aa, Sesamum indicum
MSLVANEDFQHILRVQNTNVDGKQKIMFALTSIKGIGRRFANIVCKKADIDMNKRAGELSAAEIDSLMVIVANPRQFKIPDWFLNRKKDYKDGKFSQVTSNALDMKLRDDLERLKKIRNHRGLRHYWGLRVRGQHTKTTGRRGKT

SEQ ID NO: 6706 - protein, 139 aa, Gossypium hirsutum
MSLIAGEEFQHILRVLNTNVDGKQKIMFALTSIKGVGRRFSNIACKKADIDMNKRAGELSSEEMDRLMTVVANPRQFKVPDWFLNRKKDYKDGRFTQVVSNAVDMKLRDDLERLKKIRNHRGLRHYWGVRVRGQHTIRT

SEQ ID NO: 6707 - protein, 152 aa, Mesostigma viride
MSFVAGEDFQHIIRLMNTNVDGRQKIMYALTSIRGVGRRFANVVCKKAEVDMSKRAGELSAQELESLMVIVTNPRQFKIPDWFLNRKKDIKDGRYSQVTSNVLDIKLRDDLERLKKIRNHRGLRHYWGLRVRGQHTKTTGRRGKTVGVSKKR

SEQ ID NO: 6708 - protein, 126 aa, Secale cereale
MFALTSIKGVGRRFSKHRLQEGRHRHEQEGRRAFAEEMDRLMAVVHNPRQFKVPDWFLNRKKDYKDGRFSQVVSNAVDMKLRDDLERLKKIRNHRGLRHYWGVRVRGQHTKTTGRRGKTVGVSKKR

SEQ ID NO: 6709 - protein, 135 aa, Trifolium pratense
TNVDGKQKIMFAMTSIKGIGRRFSNICCKKADVDMNKRAGELSAAELDNLMTVVANPRQFKIPDWFLNRKKDYKDGKFSQVVSNALDMKLRDDLERLKKIRNHRGLRHYWGLRVRGQHTKTTGRRGKTVGVSKKR

SEQ ID NO: 6710 - protein, 145 aa, Euphorbia peplus
GLSHILRVLNTNVDGKQKIMFALTSIKGIGRRLANIVCKKADVDMNKRAGELTAAELDNLMVIVANPRQFKIPHWFLNRQKDYKDGKYSQVVSNALDMKLRDDLERLKKIRNHRGLRHYWGLRVRGQHTKTTGRRGKTVGVSKKR

SEQ ID NO: 6711 - protein, 163 aa, Taxus baccata
ETGRGSELLRKCLLLQNEDFQHILRVLNTNVDGRQKIMFALTSIKGIGRRFANIVCKKADVDMSKRAGELSAQELENLMVIVANPRQFKIPDWFLNRKKDHKDGRFSQVVSNALDMKLRDDLERLKKIRNHRGLRHYWGLRVRGQHTKTTGRRGKTVGVSKKR

SEQ ID NO: 6712 - protein, 123 aa, Arnica chamissonis
MTSIKGIGRRFANIVCKKADVDMNKRAGELSNAEIDNLMTIVANPRQFKIPDWFLNRKKDYKDGKYSQVTSNALDMKLRDDLERLKKIRNHRGLRHYWGLRVRGQHTKTTGRRGKTVGVSKKR

SEQ ID NO: 6713 - protein, 206 aa, Saccharum officinarum
MGSSEAEKPLRRIAASFEELAAVAKQQPAVSMDAGAFSRACSNVSVLFGCLGIAFKFAEMDYVAKVDDLVEASKSISTLPSMVELDIQTDTVRKPGSHTRNLLRVKRGIDMVKVLFEQILVTEGNSLRDAASVAYAQVFAPHHGWAIRKAVAAGMYALPSKSQLLKKLNEDEESAKVQMQNFVRSSAPVICYVEELFTSRNLGIDW

SEQ ID NO: 6714 - protein, 206 aa, Zea mays
MGSSQADKPLRRIAASFEELAAVAKQHPAVPMDAGAFSRACSNVSVLFGCLGIAFKFAEMDYVAKVDDLVEASKSISTLPSMVERDIQTDTVRKPGSHTRNLLRVKRGIDMVKVLFEQILVTEGNSLRDAASVAYAQVFAPHHGWAIRKAVSAGMYALPSKSQLLKKLNEDEESAKVQMQNFVRSSAPVICYVDDLFTSRNLGIDW

SEQ ID NO: 6715 - protein, 206 aa, Cynodon dactylon
MGSNEAEKPLRRIAASFEELAAVAKQQPPGDMDTGAFSRACSNVSVLFGCLGIAFKFAEMDYVAKVDDLLEASKSISTLPSMVELDVQNDTVRKPGSHTRNMLRVKRGVDMVKVLFEQILVTEGNSLRDAASVAYAQVFAPHHGRAIRMAVAAGMYALPSKSQLLKKLNEDEASAKVQMQNFVRSSAPVIQYVEGLFTSRNLGIDW

SEQ ID NO: 6716 - protein, 206 aa, Panicum virgatum
MGSSEADKPLRRIAASFEELAAVAKQQPPGAMDAAAFSRACSNVSVLFGCLGIAFKFAERDYVAKVDDLLEASNSISTLPSMVELDIQKDTVRAVGSHTRNLLRVKRGIDMVKVLFEKMLVTEGNSLRDAASVAYAQVFAPHHGWAIRKAVAAGMYALPSKSQLLKKLNEDEESAKAQVQNFVRSSAPVIRYVEDLFTSRNLGIDW

SEQ ID NO: 6717 - protein, 206 aa, Pennisetum glaucum
MGSSEADKPLRRIASSFEELAAVAKQQPAGAMDAGAFARACSNVSVLFGCLGIAFKFAERDYVAKVDDLLEASKSISTLPSMVELDIQQDTVRVAGSHTRNLLRVKRGIDMVKVLFEQMLVTEGNSLRDAASVAYAQVFAPHHGWAIRKAVAAGMYALPSKSQLLKKLNEDEDSAKAQMQNFIRSSAPVISYVEDLFTSRNLGIDW

SEQ ID NO: 6718 - protein, 203 aa, Setaria italica
MGSSEADKPLRRIAASFEELAAVAKQQPAGAMDAGAFARACSNVSVLFGCLGIAFKFAERDYVDDLLEASKSISTLPLMVELDIQQDTVRVPGSHTRNLLRVKRGIDMVKVLFEQMLVTEGNSLRDAASVAYAQVFAPHHGWAIRKAVAAGMYALPSKSQLLKKLNEDEDSAKAQMQNFVRSSAPVISYVEDLFTSRNLGIDW

SEQ ID NO: 6719 - protein, 206 aa, Panicum virgatum
MGSSEAEKPLRRIAASFEELAAVAKQQPPGAMDAAAFSHACSNVSVLFGYLGIAFKFAEMDYVAKVNDLLEASNSVSTLPSMVELDIQKDTVRTVGSHTRNLLRVKRGIDMVKVLFEKMLVTEGNSLRDAASVAYAQVFAPHHGWVIRKAVAAGMYALPSKSQLLKKLNEDEESAKAQLQNFVRSSAPVIRYVEDLFTSRNLGIDW

SEQ ID NO: 6720 - protein, 206 aa, Avena sativa
MGSNEADKPLRRIGASFEELAAVAKQQQPAAMVAGDFSRACSHVSVLFGCLGIAFKFAEMDYVAKVDDLLEASKSISTLPSMVELDIQKGTVRVAGSHTRNLLRVKRGIDMVKVLFEQILVTEGNSLRDAASKAYAQVFAPHHGWAIRKAVGAGMYALPSKSQLLKKLNEDETSARAQMQSFVRSAGPVILYVENLFTSKNLGLDW

SEQ ID NO: 6721 - protein, 205 aa, Secale cereale
MGSNEADKPLRRIGASFEQLAAVAKQQPAAMAAGDFSRACSNVSVLFGCLGIAFKFAEMDYVAKVNDLVEASKTISTLPSMVELDIQKGTVRQAGSHTRNLLRVKRGIDMVKVLFEQILVTEGNSLKDAASKAYAQVFAPHHGWAIRKAVGAGMYALPSKSQLLKKLNEDENSARAQMQSFVRSSGPVILYVEDLFTSKNLGLDW

SEQ ID NO: 6722 - protein, 206 aa, Pseudoroegneria spicata
MGSNEADKPLRRIGASFEQLAAVAKQQQQPAMAAGDFSRACSNVSVLFGCLGIAFKFAEMDYVAKVNDLLEASKTISTLPSMVELDIQKGTVRHPGSHTRNLLRVKRGIDMVKVLFEQILVTEGNSLKDAASKAYAQVFAPHHGWAIRKAVGAGMYALPSKSQLLKKLNEDENSARAQMQSFVRSSGPVILYVEDLFTSRNLGLDW

SEQ ID NO: 6723 - protein, 205 aa, Secale cereale
MGSNEADKPLRRIGASFEQLAAVAKQQPAAMAAGDFSRACSNVSVLFGCLGIAFKFAEMDYVAKVNDLLEASKTISTLPSMVELDIQKGTVRQAGSHTRNLLRVKRGIDMVKVLFEQILVTEGNSLKDAASKAYAQVFAPHHGWAIRKAVGAGMYALPSKSQLLKKLNEDENSARAQMQSFVRSSGPVILYVEDLFTSKNLGLDW

SEQ ID NO: 6724 - protein, 205 aa, Secale cereale
MGPNEADKPLRRIGASFEQLAAVAKQQPAAMAAGDFSRACSNVSVLFGCLGIAFKFAEMDYVAKVNDLLEASKTISTLPSMVELDIQKGTVRQAGSHTRNLLRVKRGIDMVKVLFEQILVTEGNSLKDAASKAYAQVFAPHHGWAIRKAVGAGMYALPSKSQLLKKLNEDENSARAQMQSFVRSSGPVILYVEDLFTSKNLGLDW

SEQ ID NO: 6725 - protein, 208 aa, Triticum aestivum
MGSNEADKPLRRIGASFEQLAAVAKQQQPQQPAMAAGDFSRACSNVSVLFGCLGIAFKFAEMDYVAKVNDLLEASKTISTLPSMVELDIQKGTVRQAGSHTRNLLRVKRGIDMVKVLFEQILVTEGNSLKDAASKAYAQVFAPHHGWAIRKAVGAGMYALPSKSQLLKKLNEDENSARAQMQSFVRSSGPVILYVEDLFTSKNLGLDW

SEQ ID NO: 6726 - protein, 207 aa, Oryza sativa
MGSSDGDKPLRRIAASFEELEAVAKQQAPGPAMEVGSFARACSNVSVLFGCLGIAFKFAEMDYVAKVDDLLEASKSISKLPEMVELDIQKGTVRQAGSHTRNMLRVKRGIDMVKILFEQILVTEGNSLRDAASKAYAQVFAPHHGWAIRKAVAAGMYALPSKSQLLKKLNEDENSAKVQMQTFIRASGPVILYVEDLFTSRNLGMDW

SEQ ID NO: 6727 - protein, 206 aa, Hordeum vulgare
MGSNEADKPLRRIGASFEQLAAIAKQQQQPAMAAGDFSRACSNVSVLFGCLGIAFKFAEMDYVAKVNDLLEASKTISTLPSMVELDIQKGTVRQPGSHTRNLLRVKRGIDMVKVLFEQILVTEGNSLKDAATKAYAQVFAPHHGWAIRKAVGAGMYALPSKSQLLKKLNEDENSARAQMQSFVRSSGQVILYVEDLFTSSNLGLDW

SEQ ID NO: 6728 - protein, 531 aa, Zea mays
MAEPGKRAVAQWRRWALANLGPFAALFTTNFGSAWLILAPVVSLVATYAPRRLFRTYFNLFLRRRSRRLLNVVDPYVTIDISEPGGEVRYSRYGPVSDNDSTYEEVKAYLSGAAREQDARELRAEGAREGNGLVVSMRDGQDVADEFRGVPLWWSSVVARDVQGQRKGDRRFQRLTFHLSHRALVVDEYLPHVRRQGREILFSNRRRRLYTNSKSRDSYSYEYKSWSYIDFDHPTTFDTLAMDRAKKRDIIHDLDTFRNSREFYRRAGKPWKRGYLLYGPPGTGKSTMVAAMANYLDYDIYDVELTVVHTNSDLRKLLIDTTSKSIIVIEDIDCTLDVTGDRAGRPRRRANGGGDADDRPRDSVTLSGLLNFIDGLWSACTGERIVVFTTNHVERLDPALIRRGRMDMHIEMSYCRFEAFQTLAKNYLDIDDHDDLFAAVGEVLREENLTPADVAECLMAARRAGSGEPSPCLQILIDELKKRAVEKAKAEAEAKARAEAQAKAWAEAEARAAVEANAAARDRAMATHSNV

SEQ ID NO: 6729 - protein, 138 aa, Zea mays
MSVEILDGRTVQSFVEDERAFNSSVDARFAALDVDRDGRLSYAEMAGELMALRVREAHFGADAPAPAAELAALYGALFARFDRDGDGAVDRDEFRAGMREVMLAVASGLGVLPVQMVVEEGSLLKWAVDRELATTMPA

SEQ ID NO: 6730 - protein, 139 aa, Panicum virgatum
MSVEILDGRTVQSFVEDERAFNSCVDARFAALDADRDGRLSYAEMARELAALRVREAHFGADAPAPAAELARLYGALFARFDRDGDGAVGPDEFRAEMREVMLAVASGLGALPVQMVVEEGGLLRRAVDRELAATTAAC

SEQ ID NO: 6731 - protein, 139 aa, Setaria italica
MSVEILDGRTVQSFVEDERAFNSCVDARFAALDADRDGRLSYAEMARELAALRVREAHFGADAPAPAAELAELYGSLFARFDRDGDGAVGPDEFRAEMRELMLAVASGLGALPVQMVVEEGSLLRRAVDREMAAAATAA

SEQ ID NO: 6732 - protein, 138 aa, Panicum virgatum
MSVEILDGRTVRSFVEDEGAFNSCVDARFAALDADRDGRLSYAEMARELAALRVREAHFGADAPAPAAELAQLYGALFARFDRDGDGAVGPDEFRAEMREVMLAVASGLGALPVQMVVEDGGLLRRAVDRELAPTTAA

SEQ ID NO: 6733 - protein, 439 aa, Saccharum officinarum
MGSDADMEDYGFEYSDEEPEEQDVDIENQYYNSKGLVETDPEGALAGFDQVVSMEPEKAEWGFKALKQTVKLYYKLGKYKEMMDAYREMLTYIKSAVTRNYSEKCINNIMDFVSGSASQNFTLLQEFYQTTLKALEEAKNERLWFKTNLKLCKIWFDMGEYGRMSKILKELHKSCQREDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGERSKGMRKYNAIDKWNTQLKSIYQTLSNRVG

SEQ ID NO: 6734 - protein, 438 aa, Zea mays
MGSDADMEDYGFEYSDEEPEEQDVDIENQYYNSKGLVETDPEGALAGFDQVVSMEPEKAEWGFKALKQTVKLYYKLGKYKEMMDAYREMLTYIKSAVTRNYSEKCINNIMDFVSGSASQNFTLLQEFYQTTLKALEEAKNERLWFKTNLKLCKIWFDIGEYGRMSKILKELHKSCQREDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGERSKGMRKYNAIDKWNTQLKSIYQTLSNRV

SEQ ID NO: 6735 - protein, 438 aa, Zea mays
MGSDADMEDYGFEYSDEEPEEQDVDIENQYYNSKGLVETDPEGALAGFDQVVSMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYQRALSIKSAIPHPRIMGIIRECGGKMHMAERQWDEAATDFFEAFKNYDEAGNPRRIQCLKYLVLANMLMESEVNPFDGQEAKPYKNDSEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGERSKGMRKYNAIDKWNTQLKSIYQTLSNRV

SEQ ID NO: 6736 - protein, 439 aa, Panicum virgatum
MGSDADMEDYGFEYSDEEPEEQDVDIENQYYNSKGMVETDPEGALAGFDQVVKMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRIQGHIDQVNKLLERGDRSKGMRKYNAIDKWNSQLKSIYQTVSNRVG

SEQ ID NO: 6737 - protein, 439 aa, Setaria italica
MGSDADMEDYGFEYSDEEPEEQDVDIENQYYNSKGMVETDPEGALAGFDQVVKMEPEKAEWGFKALKQTVKLYYKLVKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQKEDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRIQGHIDQVNKLLERGDRSKGMRKYNAIDKWNTQLKTIYQTVSNRVG

SEQ ID NO: 6738 - protein, 439 aa, Oryza sativa
MGSDADMEDYGFEYSDDEPEEQDVDIENQYYNSKGMVETDPEGALAGFDQVVRMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYTKALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGDRSKGMRKYQAIDKWNTQLKNIYQTVSNRVG

SEQ ID NO: 6739 - protein, 439 aa, Unknown
  Sequence found in Organisms: Hordeum vulgare, Secale cereale, Triticum aestivum
MGSDADMEDYGFEYSDDEPEEQDVDIENQYYNSKGMVETDPEGALAGFDAVVRMEPEKAEWGFKALKQTVKLYYKLGKYKEMMDAYREMLTYIKSAVTRNYSEKCINNIMDFVSGSASQHFNLLQEFYQTTLKALEEAKNERLWFKTNLKLCKIWFDMGEYGRMSKILKELHKSCQKEDGSDDQKKGTQLLEVYAIEIQMYTETKNNKKLKELYQRALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRVQGHIDQVNKLLECGDRSKGMRKYQAIDKWNTQLKSIYQTVSNRVG

SEQ ID NO: 6740 - protein, 439 aa, Avena sativa
MGSDADMEDYGFEYSDDEPEEQDVDIENQYYNSKGMVETDPEGALNGFGGVVRMEPEKAEWGFKALKQTVKLYYKLGKYKEMMDAYREMLTYIKSAVTRNYSEKCINNIMDFVSGSASQHFSLLQEFYQTTLKALEEAKNERLWFKTNLKLCKIWFDMGEYGRMSKILKELHKSCQKEDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRVQGHIDQVNKLLECGDRSKGMRKYQAIDKWNTQLKSIYQTVSNRVG

SEQ ID NO: 6741 - protein, 433 aa, Brachypodium distachyon
MEDYGFEYSDDEPEEQDVDIENQYYNSKGMVETDAEGALAGFDAVVRMEPEKGEWGFKALKQTVKIYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQKEDGSDDQKKGTQLLEVYAIEIQMYTETKNNKKLKELYQRALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKTNRRTIMDDPFIRNYIEDLLKNIRTQVLLKLIKPYTRIRIPFISQELNFPEKDVEQLLVSLILDNRVQGHIDQVNKLLECGDRSKGMRKYQAIDKWNTQLKSIYQTVSNRVG

SEQ ID NO: 6742 - protein, 439 aa, Theobroma cacao
MASDADMEDYGFEYSDEEPEEQDVDIENQYYNSKGLVETDPEGALAGFAEVVNMEPEKAEWGFKALKQTVKLYYRLGRYKEMMDAYREMLTYIKSAVTRNYSEKCINNIMDFVSGSASQNFGLLQEFYQTTLKALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIDKWNTQLRSLYQTVSNRVY

SEQ ID NO: 6743 - protein, 439 aa, Ricinus communis
MGSDADMEDYGFEYSDDEPEEQDVDIENQYYNSKGLVETDPEAALAGFAEVVSMEPEKAEWGFKALKQTVKLYYRLGKYKEMMDAYREMLTYIKSAVTRNYSEKCINNIMDFVSGSASQNFGLLQEFYQTTLKALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIDKWNTQLRSLYQTISNRVY

SEQ ID NO: 6744 - protein, 439 aa, Citrus clementina
MGSDADMEDYGFEYSDEEPEEQDVDIENQYYNSKGLVETDPEGALAGFAEVVAMEPEKAEWGFKALKQTVKLYYRLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWADAATDFFEAFKNYDEAGNQRRIQCLKYLVLANMLMESQVNPFDGQEAKPYKNDPEILAMTNLIAAYQRNEIIEFEKILKSNRKTIMDDPFIRNYIEDLLKNVRTQVLLKLIKPYTRIRIPFISKELNVPEKDVEQLLVSLILDNRIDGHIDQVNRLLERGDRSKGMKKYTAIDKWNSQLRSLYQTVSNRVS

SEQ ID NO: 6745 - protein, 439 aa, Populus trichocarpa
MGSDADMEDYGFEYSDEEPEEQDVDIENQYYNSKGLVETDPEGALAGFAEVVSMEPEKAEWGFKALKQTVKLYYRLGKYKEMMEAYREMLTYIKSAVTRNYSEKCINNIMDFVSGSASQNFGLLQEFYQTTLKALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIEKWNAQLRSLYQTVSNRVS

SEQ ID NO: 6746 - protein, 439 aa, Populus trichocarpa
MGSDADMEDYGFEYSDEEPEEQDVDIENQYYNSKGLVETDPEGALAGFAEVVSMEPEKAEWGFKALKQTVKIYYRLGKYKEMMEAYREMLTYIKSAVTRNYSEKCINNIMDFVSGSASQNFSLLQEFYQTTLKALEEAKNERLWFKTNLKLCKIWFGMGEYGRMSKILKELHKSCQREDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIEKWNTQLRSLYQTVSNRVY

SEQ ID NO: 6747 - protein, 439 aa, Unknown
  Sequence found in Organisms: Prunus persica, Prunus mume
MGSDADMEDYGFEYSDEEPEEQDVDIENQYYNSKGLVETDPEGALSGFDEVVRMEPEKAEWGFKALKQTVKLYYRLGRYKEMMDAYRVMLTYIKSAVTRNYSEKCINNIMDFVSGSASQNFGLLQEFYQTTLKALEEAKNERLWFKTNLKLCKIWFDMGEYGRMNKILKELHKSCQKEDGTDDQKKGSQLLEVYAIEIQMYTETKNNKKLKQLYQKALAIKSAIPHPRIMGIIRECGGKMHMAERQWADAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYAAIDKWNTQLKSLYQTISNRVY

SEQ ID NO: 6748 - protein, 439 aa, Unknown
  Sequence found in Organisms: Gossypium hirsutum, Gossypium raimondii
MASDADMEDYGFEYSDEEPEEQDVDIENQYYNSKGLVETDPEGALVGFSEVVSMEPEKAEWGFKALKQTVKLYYRLGKYKEMMDSYREMLTYIKSAVTRNYSEKCINNIMDFVSGSASQNFDLLQEFYQTTLKALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFEKILKSNRRTIMDDPFIRNYIEDLLKNVRTQVLLKLIKPYTRIRIPFISKELNVPEKDVEQLLVSLILDNRIEGHIDQVNRLLERGDRSKGMKKYTAIDKWNTQLRSLYQAVSNRVS

SEQ ID NO: 6749 - protein, 439 aa, Euphorbia peplus
MGSDADMEDYGFEYSDEEPEEQDVDIENQYYNSKGLVETDPEGALAGFAEVVSMEPEKAEWGFKALKQTVKLYYRLGKYKEMMDAYREMLTYIKSAVTRNYSEKCINNIMDFVSGSASQNFGLLQEFYQTTLRALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWPDAATDFFEAFKNYDEAGNHRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIEKWNTQLRSLYQTVSNRVY

SEQ ID NO: 6750 - protein, 439 aa, Vitis vinifera
MGSDADMEDYGFEYSEEEPEEQDVDIENQYYNSKGLVETDPEGALAGFAEVVRMEPEKAEWGFKALKQTVKLYYRLGKYKEMMEAYRVMLTYIKSAVTRNYSEKCINNIMDFVSGSASQNFGLLQEFYQTTLKALEEAKNERLWFKTNLKLCKIWFDMGEYGRMSKILKELHKSCRREDGTDDQKKGTQLLEVYAIEIQMYTETKNNKKLKQLYQKALTIKSAIPHPRIMGIIHECGGKMHMAERQWADAATDFFEAFKNYDEAGNQRRIQCLKYLVLANMLMESEVNPFDGQEAKPYKNDPEILAMTNLIAAYQRNEILEFEKILKSNRRTIMDDLFIRNYIEDLLKNIRTQVLLKLIKPYTRIRIPFISKELNVPEEDVEQLLVSLILDNRIQGHIDQVNRLLERGDRSKGMKKYAAVEKWNTQLKSLYQTISNRVG

SEQ ID NO: 6751 - protein, 439 aa, Elaeis guineensis
MGSDADMEDYGFEYSDDEPEEQDVDIENQYYNSKGLVETDPEEALAGFAEVVRMEPEKAEWGFKALKQTVKLYYRLGRYKEMMEAYRVMLTYIKSAVTRNYSEKCINNIMDFVSGSASQNFSLLQEFYQTTLKALEEAKNERLWFKTNLKLCKIWFDMGEYGRMNKILKELHKSCRKEDGSDDHKKGTQLLEVYAIEIQMYTETKNNKKLKQLYQKALSIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEKDVEQLLVSLILDNRIQGHIDQVNRLLERTDRSKGTKKYTAIDKWNTQLRSLYQTISNRVG

SEQ ID NO: 6752 - protein, 281 aa, Euonymus alatus
MGEYGRMSKILKELHKSCQREDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYAAIDKWNTQLRSLYQTVSNRV

SEQ ID NO: 6753 - protein, 439 aa, Gossypium hirsutum
MASDADMEDYGFEYSDEEPEEQDVDIENQYYNSKGLVETDPEGALAGFAEVVSMEPEKAEWGFKALKQTVKLYYRLGRYKEMMEAYREMLTYIKSAVTRNYSEKCINNIMDFVSGSASQNFGLLQEFYQTTLKALEEAKNERLWFKTNLKLCKIWFDMGEYGRMSKILKELHKSCQKEDGTDDQKKGSQLLEVYAIEIQMYTETKNNKKLKQLYQKALAVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFEKILKSNRRTIMDDPFIRNYIEDLLKNVRTQVLLKLIKPYTRIRIPFISKELNVPEKDVEQLLVSLILDNRIDGHIDQVNRLLERGNRSKGMKKYTAIDKWNTQLRSLYQTVNNRVY

SEQ ID NO: 6754 - protein, 439 aa, Eucalyptus grandis
MASDADMEDYGFEYSDEEPEEQDVDIENQYYNSKGLIETDPEGALAGFAEVVRMEPEKAEWGFKALKQTVKLYYRLGKYKEMMDSYRVMLTYIKSAVTRNYSEKCINNVMDFVSGSASQNFSLLQEFYQTTLKALEEAKNERLWFKTNLKLCKIWFDMGEYGRMNKILKELHKSCQREDGTDDHKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDLFIRNYIEDLLKNIRTQVLLKLIKPYTRIRIPFISKELNVPEKDVEQLLVSLILDNRIDGHIDQVNRLLERGDRSKGMKKYAAIDKWNTQLKSLYQTINNRVY

SEQ ID NO: 6755 - protein, 438 aa, Euonymus alatus
MGSDADMEDYGFEYSDEEPEEQDVDIENQYYNSKGLVETDPEGALEGFAEVVRMEPEKAEWGFKALKQTVKLYYRLVKYTEMMDAYREMLTYIKSAVTRNYSEKCINNIMDFVSGSASQNFGLLKEFYQTTLKALEEAKNERLWFKTNLKLCKIWFDMGEYGRMNKILKELHKSCQREDGTDDQKKGSQLLEVYAIEIQMYTETKNNKKLKQLYLQALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYAAIDKWNTQLRSLYQTVSNRV

SEQ ID NO: 6756 - protein, 439 aa, Nicotiana benthamiana
MGSDADMEDYGFEYSDEEPEEQDVDIENQYYNSKGLVETEPEAALEGFAEVVRMEPEKAEWGFKALKQTVKLYYKLGKYKEMMDAYREMLTYIKSAVTRNYSEKCINNIMDFVSGSASQNFSLLQEFYETTLKALEEAKNERLWFKTNLKLCKIWFDIGEYGRMSKILKELHKSCQKEDGTDDQKKGTQLLEVYAIEIQMYTETKNNKKLKELYNKALSVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLRNVRTQVLLKIIKPYTRIRIPFISKELNVPEKDVEELLVSLILDNRIHGHIDQVNRLLECGDRSKGMKKYAAIDKWNTQLKSLYQTVGNRVC

SEQ ID NO: 6757 - protein, 439 aa, Amsonia hubrichtii
MGSDVDMEDYGFEYSDEEPEEQDVDIENQYYNSKGMVETDPEAALEGFAEVVRMEPEKAEWGFKALKQTVKLYYKLGKYKEMMDAYRDMLTYIKSAVTRNYSEKCINNIMDFVSGSASQNFSLLQEFYQTTLKALEEAKNERLWFKTNLKLCKIWFDMGEYGRMSKILKELHKSCQKEDGTDDQKKGTQLLEVYAIEIQMYTETKNNKKLKQLYQKALSIKSAIPHPRIMGIIRECGGKMHMAERQWPEAATDFFEAFKNYDEAGNQRRIQCLKYLVLANMLMESQVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEELLVSLILDNRIHGHIDQVNRLLEREDSSKGMKKYAAIDKWNTQLRSLYQTVSNRVC

SEQ ID NO: 6758 - protein, 439 aa, Aristolochia fimbriata
MGSDADMEDYGFEYSDEEPEEQDVDIENQYYNSKGLVETDPEGALAGFAEVVRMEPQKAEWGFKALKQTVKLYYRLGKYKEMMEAYRVMLTYIKSAVTRNYSEKCINNIMDFVSGSASQNFGLLQEFYQTTLRALEEAKNERLWFKTNLKLCKIWFDMGEYGRMNKILKELHKSCRREDGTDDQKKGTQLLEVYAIEIQMYTETKNNKKLKQLYQKALSIKSAIPHPRIMGIIHECGGKMHMAERQWAEAATDFFEAFKNYDEAGNHRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEKDVESLLVSLILDNRIHGHIDQVNRLLERGDRSKGMKKYTAIDTWNTQLRSLYQTVAYRVG

SEQ ID NO: 6759 - protein, 439 aa, Mimulus guttatus
MGSDADMEDYGFEYSDEEPEEQDVDIENQYYNSKGLVESDPEAALEGFAEVVNMEPEKAEWGFKALKQTVKLYYKLGKYKEMMDAYRDMLTYIKSAVTRNYSEKCINNIMDFISGSAGQNFSLLQEFYQTTLKALEEAKNERLWFKTNLKLCKIWFDIGEYGRMSKILKELHKSCQKEDGTDDQKKGTQLLEVYAIEIQMYTETKNNKKLKELYQKALSVKSAIPHPRIMGIIRECGGKMHMAERQWPDAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEALLVSLILDNRIDGHIDQVNRLLERGDRSKGMKKYTAIDKWNTQLKSLYQTVGNRVY

SEQ ID NO: 6760 - protein, 439 aa, Triphysaria pusilla
MGSDADMEDYGFEYSDEEPEEQDVDIENQYYNSKGLVETEPEAALEGFSEVVNMEPEKAEWGFKALKQTVKLYYKLGKYKEMMDAYRGMLTYIKSAVTRNYSEKCINNIMDFISGSASQNFSLLQEFYQTTLFALEEAKNERLWFKTNLKLCKIWFDIGEYGRMSKILKELHKSCQKEDGTDDQKKGTQLLEVYAIEIQMYTETKNNKKLKELYQKALTVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEELLVSLILDNRIDGHIDQVNRLLERGDRTKGMKKYTAIDKWNTQLKSLYQTVGNRVC

SEQ ID NO: 6761 - protein, 328 aa, Lippia dulcis
MGSDADMEDYGFEYSDEEPEEQDVDIENQYYNSKGLVETDPEGALEGFAEVVRMEPEKAEWGFKALKQTVKLYYKLGRYKEMMDAYRDMLTYIKSAVTRNYSEKCINNIMDFISGSAGQNFNLLQEFYQTTLKALEEAKNERLWFKTNLKLCKIWFDIGEYGRMSKILKELHKSCQKEDGTDDQKKGTQLLEVYAIEIQMYTETKNNKKLKELYQKALSVKSAIPHPRIMGIIRECGGKMHMAERQWPDAATDFFEAFKNYDEAGNQRRIQCLKYLVLANMLMESEVNPFDGQEAKPYKNDPEILAMTNLIAAYQRNEILEFRKNFEE

SEQ ID NO: 6762 - protein, 439 aa, Phaseolus vulgaris
MASDADMEDYGFEYSDEEQEEQDVDIENQYYNSKGLVETDPEGALAGFAEVVRMEQEKAEWGFKALKQTVKLYYRLGRYKEMMEAYREMLTYIKSAVTRNYSEKCINSIMDYVSGSASQNFGLLQEFYQTTLKALEEAKNERLWFKTNLKLCKIFFDIGEYGRMSKILKELHKSCQREDGTDDHKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPENDVEQLLVSLILDNRIQGHIDQVNRLLERSDRSKGMKKYTAIDKWNTQLKSLYQTISNRVG

SEQ ID NO: 6763 - protein, 439 aa, Nicotiana benthamiana
MGSDADMEDYGFEYSDEEPEEQDVDIENQYYNSKGLVETEPEAALEGFAEVVRMEPEKAEWGFKALKQTVKLYYKLGKYKEMMDAYREMLTYIKSAVTRNYSEKCINSIMDFVSGSASQNFSLLQEFYETTLKALEEAKNERLWFKTNLKLCKIWFDIGEYGRMSKILKELHKSCQKEDGTDDQKKGTQLLEVYAIEIQMYTETKNNKKLKELYNKALSVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLRNVRTQVLLKIIKPYTRIRIPFISKELNVPEKDVEELLVSLILDNRIHGHIDQVNRLLECGDRSKGMKKYAAIDKWNTQLKSLYQTVGNRVC

SEQ ID NO: 6764 - protein, 439 aa, Ambrosia trifida
MGSDADMEDYGFEYSEEEPEEQDVDIENQYYNSKGLVETDPEGALSGFAEVVQMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPETDVEQLLVSLILDNRVQGHIDQVNRLLECGDRSKGMKKYTAVDKWNTQLRSLYQTVSNRVG

SEQ ID NO: 6765 - protein, 433 aa, Musa acuminata
MEDYGFEYSDEEPEEQDVDIENQYYNSKGLVETDPEEALAGFAEVVRMEPEKAEWGFKALKQTVKLYYRLGKYKEMMEAYREMLTYIKSAVTRNYSEKCINNIMDFVSGSASQNFGLLQEFYETTLKALEEAKNERLWFKTNLKLCTIWFDIGEYGRMSKILKELHKSCQREDGTDDQKKGTQLLEVYAIEIQMYTQTKNNKKLKQLYQKALSIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEKDVEQLLVSLILDNRIQGHIDQVNKLLERSDRSKGMKKYAAIDKWNTQLRSLYQTISNRVG

SEQ ID NO: 6766 - protein, 439 aa, Citrullus lanatus
MGSDADMEDYGFEYSDDEPEEQDVDIENQYYNSKGLVETDPEGALAGFAEVVRMEPDKAEWGFKALKQTVKLYYRLGKYKEMMDSYRVMLTYIKSAVTRNYSEKCINNIMDFVSGSASQSFGLLQEFYQTTLKALEEAKNERLWFKTNLKLCKIWFDIGEYGRMIKILKELHKSCQREDGTDDQKKGSQLLEVYAIEIQMYTETKNNKKLKQLYQKALAIKSAIPHPRIMGIIRECGGKMHMAERQWPEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIDKWNTQLKSLFQTVSNRVY

SEQ ID NO: 6767 - protein, 439 aa, Cucurbita pepo
MGSDADMEDYGFEYSDDEPEEQDVDIENQYYNSKGLVEMDPEGALAGFAEVVRMEPEKAEWGFKALKQTVKLYYRLGRYKEMMDSYRVMLTYIKSAVTRNYSEKCINNIMDFVSGSASQSFGLLQEFYQTTLKALEEAKNERLWFKTNLKLCKIWFDIGEYGRMIKILKELHKSCQREDGTDDQKKGSQLLEVYAIEIQMYTETKNNKKLKQLYQKALAIKSAIPHPRIMGIIRECGGKMHMAERQWPEAATDFFEAFKNYDEAGNQRRIQCLKYLVLANMLMESEVNPFDGQEAKPYKNDPEILAMTNLIAAYQRNEILEFEKILKSNRKTIMDDPFIRNYIEDLLKNVRTQVLLKLIKPYTRIRIPFISKELNVPEKDVEQLLVSLILDNRIDGHIDQVNRLLERGDRSKGMKKYTAIDKWNTQLKSLYQTVSNRVY

SEQ ID NO: 6768 - protein, 433 aa, Manihot esculenta
MEDYGFEYSDEEPEEQDVDIENQYYNSKGLVETDPEGALAGFAEVVSMEPEKAEWGFKALKQTVKLYYRLGKYKEMMDAYREMLTYIKSAVTRNYSEKCINSIMDFVSGSASQNFGLLQEFYQTTLKALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWDEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIEKWNTQLRSLHQTISNRVY

SEQ ID NO: 6769 - protein, 439 aa, Unknown
  Sequence found in Organisms: Centaurea maculosa, Cirsium arvense
MGSDADMEDYGFEYSEEEPEEQDVDIENQYYNSKGLVETDPEGALSGFAEVVKMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNRVQGHIDQVNRLLECGDRSKGMKKYTAVEKWNTQLRSLYQSVSNRVG

SEQ ID NO: 6770 - protein, 439 aa, Cirsium arvense
MGSDADMEDYGFEYSEEEPEEQDVDIENQYYNSKGLVETDPEGALTGFAEVVQMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNRVQGHIDQVNRLLECGDRSKGMKKYTAVEKWNTQLRSLYQSVSNRVG

SEQ ID NO: 6771 - protein, 439 aa, Glycine max
MASDADMEDYGFEYSDEEQEEQDVDIENQYYNSKGLVESDPEGALAGFAEVVRMEQEKAEWGFKALKQTVKLYYRLGRYKEMMEAYREMLTYIKSAVTRNYSEKCINSIMDYVSGSASQNFGLLQEFYQTTLKALEEAKNERLWFKTNLKLCKIFFDIGEYGRMSKILKELHKSCQREDGTDDHKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERSDRSKGMKKYTAVDKWNTQLKSLYQTISNRVG

SEQ ID NO: 6772 - protein, 439 aa, Helianthus annuus
MGSDADMEDYGFEYSEEEPEEQDVDIENQYYNSKGLVETDPEGALSGFAEVVQMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPETDVEQLLVSLILDNRVQGHIDQVNRLLECGDRSKGMKKYTAVEKWNTQLRSLYQSVSNRVG

SEQ ID NO: 6773 - protein, 439 aa, Olea europaea
MGSDADMEDYGFEYSDEEPEEQDVDIENQYYNSKGLVETDPEAALEGFAEVVRMEPDKAEWGFKALKQTVKLYYKLVKYKEMMLAYRDMLTYIKSAVTRNYSEKCINNIMDFISGSAGQNFNLLKEFYQTTLKALEEAKNERLWFKTNLKLCKIWFDMGEYGRMNKILKELHKSCQKEDGTDDQKKGTQLLEVYAIEIQMYTETKNNKKLKELYLRALSIKSAIPHPRIMGIIRECGGKMHMAERQWADAATDFFEAFKNYDEAGNHRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEELLVSLILDNRIHGHIDQVNRLLERGDRSKGMKKYNAIEKWNTQLRSLYQTVGNRVS

SEQ ID NO: 6774 - protein, 439 aa, Unknown
  Sequence found in Organisms: Cichorium intybus, Lactuca sativa
MGSDADMEDYGFEYSEEEPEEQDVDIENQYYNSKGLVETDPEGALTGFAEVVQMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNKVQGHIDQVNRLLERGDRSKGMKKYTAVEKWNTQLRSLYQSVGNRVG

SEQ ID NO: 6775 - protein, 439 aa, Flaveria ramosissima
MGSDADMEDYGFEYSEEEPEEQDVDIENQYYNSKGLVETDPEAALSGFAEVVQMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNRVQGHIDQVNRLLECGDRSKGMKKYTAVEKWNTQLRSLYQSVSNRVG

SEQ ID NO: 6776 - protein, 433 aa, Gossypium raimondii
MEDYGFEYSDEEPEEQDVDIENQYYNSKGLVETDPEGALAGFAEVVSMEPEKAEWGFKALKQTVKLYYRLGRYKEMMEAYREMLTYIKSAVTRNYSEKCINNIMDFVSGSASQNFGLLQEFYQTTLKALEEAKNERLWFKTNLKLCKIWFDMGEYGRMSKILKELHKSCQKEDGTDDQKKGSQLLEVYAIEIQMYTETKNNKKLKQLYQKALAVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFEKILKSNRRTIMDDPFIRNYIEDLLKNVRTQVLLKLIKPYTRIRIPFISKELNVPEKDVEQLLVSLILDNRIDGHIDQVNRLLERGNRSKGMKKYTAIDKWNTQLRSLYQTVNNRVY

SEQ ID NO: 6777 - protein, 439 aa, Cajanus cajan
MASDADMEDYGFEYSDEEQEEQDVDIENQYYNSKGLVETDPEGALSGFAEVVRMEQEKAEWGFKALKQTVKLYYRLGRYKEMMEAYREMLTYIKSAVTRNYSEKCINSIMDYVSGSASQNFGLLQEFYQTTLKALEEAKNERLWFKTNLKLCKIFFDIGEYGRMSKILKELHKSCQREDGTDDHKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRKTIMDDPFIRNYIEDLLKNIRTQVLLKLIKPYTRIRIPFISKELNVPEHDVEQLLVSLILDNRIQGHIDQVNRLLERSDRSKGMKKYTAVDKWNTQLKSLYQTISNRVG

SEQ ID NO: 6778 - protein, 439 aa, Plantago ovata
MGSDADMEDYGFEYSDDEPEEQDVDIENQYYNSKGLVESDPEAALEGFAEVVRMEPEKADWGFKALKQTVKLYYKLGKYKEMMDAYRDMLTYIKSAVTRNYSEKCINNIMDFISGSASQNFALLQEFYQTTLRALEEAKNERLWFKTNLKLCKIWFDMGEYGKMSKILKELHKSCQKEDGSDDQKKGTQLLEVYAIEIQMYTETKNNKKLKELYQKALTIKSAIPHPRIMGIIRECGGKMHMAERQWAEAATDFFEAFKNYDEAGNHRRIQCLKYLVLANMLMESQVNPFDGQEAKPYKSDPEILAMTNLIAAYQKNEILEFEKILKSNRRTIMDDPFIRNYIEDLLKNVRTQVLLKLIKPYTRIRLPFISKELNVPEKDVEDLLVSLILDNRIDGHIDQVNRLLERGDRSKGMKKHAAVDKWNTQLKSLYQTIGNRVC

SEQ ID NO: 6779 - protein, 135 aa, Arachis hypogaea
MASDADMEDYGFEYSDEEQEEQDVDIENQYYNSKGLVETDPEGALSGFAEVVRMEQEKAEWGFKALKQTVKLYYRLGRYKEMMEAYREMLTYIKSAVTRNYSEKCINSIMDYVSGSASQNFGLLQKLLPDNSESP

SEQ ID NO: 6780 - protein, 322 aa, Flaveria ramosissima
MGSDADMEDYGFEYSEEEPEEQDVDIENQYYNSKGLVETDPEGALSGFAEVVQMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKTYDEAGNQRRIQCLKYLVLANMLMQSEVNPFDGQEAKPYKNDPEILAMTNLIAAYQRNEILGI

SEQ ID NO: 6781 - protein, 439 aa, Glycine max
MASDADMEDYGFEYSDEEQEEQDVDIENQYYNSKGLVETDPEGALSGFAEVVRMEQEKAEWGFKALKQTVKLYYRLGRYKEMMEAYREMLTYIKSAVTRNYSEKCINSIMDYVSGSASQNFGLLQEFYQTTLQALEEAKNERLWFKTNLKLCKIFFDIGEYGRMSKILKELHKSCQREDGTDDHKKGTQLLEVYAIEIQMYTEMKNNKKLKQLYQKALTIKSAIPHPRIMGIIHECGGKMHMAERQWAEAATDFFEAFKNYDEAGNHRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERSDRSKGMKKYTAVDKWNTQLKSLYQTISNRVG

SEQ ID NO: 6782 - protein, 439 aa, Amborella trichopoda
MGSDADMEDYGFEYSEEEPEEQDVDIENQYYNSKGLVESDPEGALAGFAEVVRMEPEKADWGFKALKQTVKLYYRLGRYKEMMDAYRDMLTYIKSAVTRNYSEKCINNIMDFVSGSASQNFDLLQEFYQTTLKALEESKNERLWFKTNLKLCKIWFDMGEYGRMNKILKELHKSCRREDGSDDQKKGTQLLEVYAIEIQMYTETKNNKKLKQLYNKALSIKSAIPHPRIMGIIHECGGKMHMAERQWAQAATDFFEAFRNYDEAGNQRRIQCLKYLVLANMLMESQVNPFDGQEAKPYKNDPEILAMTNLVAAYQRNEILEFEKILKSNRRTIMDDPFVRNYIEDLLKNIRTQVLLKLIKPYTRIRIPFISKELNVPEKDVEQLLVSLILDNRINGHIDQVNRLLERGDRSKGMKKYTAIEKWNTQLRSLYQTVTNRIG

SEQ ID NO: 6783 - protein, 433 aa, Manihot esculenta
MEDYGFEYSDEEPEEQDVDIENQYYNSKGMVETDPEGALAGFAEVVSMEPEKAEWGFKALKQTVKLYYRLGKYKEMMVSYREMLTYIRSAVTRNYSEKCINNIMDFVSGSASQNFGLLQEFYQTTLRALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIEKWNTQLRSLYQAVSNRVH

SEQ ID NO: 6784 - protein, 439 aa, Unknown
  Sequence found in Organisms: Castanea mollissima, Quercus alba
MGSDADMEDYGFEYSEEEQEEQDVDIENQYYNAKGLVETDPEGALAGFSEVVHMEAEKAEWGFKALKQTVKLYYRLGKYEEMMQAYREMLTYIKSAVTRNYSEKCINSIMDFVSGSASQNFGLLQEFYQTTLKALEEAKNERLWFKTNLKLCKIWFDMGEYGRMSKILKELHKSCRKEDGSDDHKKGTQLLEVYAIEIQMYTETKNNKKLKQLYQQALMIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEQDVEQLLVSLILDNRIHGHIDQVNRLLERWDRSKGTKKYAAVEKWNTQLKSLYQTINNRVC

SEQ ID NO: 6785 - protein, 439 aa, Cicer arietinum
MASDADMEDYGFEYSDEEQEEQDVDIENQYYNSKGLVETDPEGALSGFAEVVRMEQDKAEWGFKALKQTVKLYYRLGRYKEMMEAYREMLTYIKSAVTRNYSEKCINSIMDYVSGSASQNFGLLQEFYQTTLKALEEAKNERLWFKTNLKLCKIFFDIGEYGRMSKILKELHKSCQKEDGTDDHKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERSDRSKGMKKYTAVDKWNTQLKSLYQTINNRVG

SEQ ID NO: 6786 - protein, 439 aa, Trigonella foenum-graecum
MASDADMEDYGFEYSDEEQEEQDVDIENQYYNSKGLVEADPEGALSGFSEVVRMEQDKAEWGFKALKQTVKLYYKLGRYKEMMEAYREMLTYIKSAVTRNYSEKCINSIMDYVSGSASQNFGLLQEFYQTTLRALEEAKNERLWFKTNLKLCKIFFDIGEYGRMSKILKELHKSCQREDGTDDHKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERSDRSKGMKKYTAVDKWNTQLKSLYQTINNRVG

SEQ ID NO: 6787 - protein, 439 aa, Vinca minor
MGSDVDMEDYGFEYSDEEPEEQDVDIENQYYNSKGMVETDPEAALEGFAEVVRMEPNKADWGFKALKQTVKLYYKLGKYEEMMDAYRDMLTYIKTAVTRNYSEKCINNIMDFVSGSASQNFSLLQEFYQTTLKALEEAKNERLWFKTNLKLCKIWFDMGEYGRMNKILKELHKSCQKEDGTDDQKKGTQLLEVYAIEIQMYTATKNNKKLKQLYQKALSIKSAIPHPRIMGIIRECGGKMHMAERQWAEAATDFFEAFKNYDEAGYQRRIQCLKYLVLANMLMESQVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEDLLVSLILDNRIHGHIDQVNRLLERGDSSKGMKKYAAVDKWNTQLRSLYQTVSNRVC

SEQ ID NO: 6788 - protein, 439 aa, Solanum tuberosum
MGSDADMEDYGFEYSEEEPEEQDVDIENQYYNSKGLAETDPEAALEGFAEVVHMEPEKADWGFKALKQTVKLYYKLGKYKEMMDAYREMLTYIKSAVTRNYSEKCINNIMDFVSGSASQNFDLLQEFYQTTLKALEEAKNERLWFKTNLKLCKIWFDIWEYGRMNKILKQLHKSCQKEDGTDDQKKGTQLLEVYAIEIQMYTETKNNKKLKELYTKALSVKSAIPHPRIMGIIRECGGKMHMAERQWAEAATDFFEAFKNYDEAGNQRRIQCLKYLVLANMLMESEVNPFDGQEAKPYKTDPEILAMTNLIAAYQRNEILEFEKILKSNRRTIMDDPFIRNYIEDLLRNVRTQVLLKIIKPYTRIRIPFISKELNVPEKDVEELLVSLILDNRIHGHIDQVNRLLECGDRSKGMKKYAAIDKWNTQLRSLYQTVGNRVC

SEQ ID NO: 6789 - protein, 439 aa, Pseudotsuga menziesii
MGSDADMEDYGFEYSEEETEEQDVDIENQYYNSKGLVESDPQEALAGFAEVVRMEPEKAEWGFKALKQTVKLYYRLGKYKEMMDSYRVMLTYIRSAVTRNYSEKCINNIMDFVSGSASQNFELLQEFYQTTLKALEEAKNERLWFKTNLKLCKIFFDMGEYGRMNKILKELHKSCRREDGSDDQKKGTQLLEVYAIEIQMYTETKNNKKLKQLYQKALSIKSAIPHPRIMGIIHECGGKMHMAERQWAEAATDFFEAFKNYDEAGNHRRIQCLKYLVLANMLMESEVNPFDGQEAKPYKNDPEILAMTNLVAAYQRNEILEFEKILKSNRRTIMDDPFIRNYIEDLLKNIRTQVLLKLIKPYTRIRIPFISKELNVPEKDVEQLLVSLILDNRVHGHIDQVNQLLELGDRSKGLKKYVAIDKWNTQLRSLYQTVTNKMG

SEQ ID NO: 6790 - protein, 439 aa, Picea glauca
MGSDADMEDYGFEYSEEETEEQDVDIENQYYNSKGLVESDPQEALAGFAEVVKMEPEKAEWGFKALKQTVKLYYRLGKYKEMMDSYRVMLTYIRSAVTRNYSEKCINNIMDFVSGSASQNFELLQEFYQTTLKALEEAKNERLWFKTNLKLCKIFFDMGEYGRMNKILKELHKSCRREDGSDDQKKGTQLLEVYAIEIQMYTETKNNKKLKQLYQKALSIKSAIPHPRIMGIIHECGGKMHMAERQWAEAATDFFEAFKNYDEAGNHRRIQCLKYLVLANMLMESEVNPFDGQEAKPYKNDPEILAMTNLVAAYQRNEILEFEKILKSNRRTIMDDPFIRNYIEDLLKNIRTQVLLKLIKPYTRIRIPFISKELNVPEKDVEQLLVSLILDNRVHGHIDQVNQLLELGDRSKGLKKYVAIDKWNTQLRSLYQTVTNKMG

SEQ ID NO: 6791 - protein, 439 aa, Solanum lycopersicum
MGSDADMEDYGFEYSEEEPEEQDVDIENQYYNSKGLAETDPEAALEGFAEVVRMEPEKADWGFKALKQTVKLYYKLGKYKGMMDAYREMLTYIKSAVTRNYSEKCINNIMDFVSGSASQNFDLLQEFYQTTLKALEEAKNERLWFKTNLKLCKIWFDIGEYGRMNKILKELHKSCQKEDGTDDQKKGTQLLEVYAIEIQMYTETKNNKKLKELYTKALSVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLRNVRTQVLLKIIKPYTRIRIPFISKELNVPEKDVGELLVSLILDNRINGHIDQVNRLLECGDRSKGMKKYAAIDKWNTQLRSLYRTVGNRVC

SEQ ID NO: 6792 - protein, 358 aa, Arnica chamissonis
MTDAYREMLTYIKSAVTRNYSEKCINNIMDFVSGSASQNFGLLQDFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNRVQGHIDQVNRLLMCGDRSKGTKKYTAVEKWNTQLRSLYRSVSNRVG

SEQ ID NO: 6793 - protein, 163 aa, Pinus pinaster
MGSDADMEDYGFEYSEEETEEQDVDIENQYYNSKGLVESDPQEALAGFAEVVKMEPEKAEWGFKALKQTVKLYYRLGKYKEMMDSYRVMLTYIRSAVTRNYSEKCINNIMDFVSGSASQNFELLQEFYQTTLKALEEAKNERLWFKTNLKLCKIFSIWENMVA

SEQ ID NO: 6794 - protein, 437 aa, Ambrosia trifida
MGSDMEDYGFEYSEEEPEEQDVDIENQYYNSKGLVETDPEGALSGFAEVVQMEPEKAEWGFKALKQTVKLYYRLGRYKEMTDAYREMLTYIKSAVTRNYSEKCINSIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEELLVSLILDNRVQGHIDQVNRLLECGDRSKGMKKYTAVDKWNTQLRSLYHSVANRVG

SEQ ID NO: 6795 - protein, 439 aa, Medicago truncatula
MASDADMEDYGFEYSDEEQEEQDVDIENQYYNSKGLVETDPEGALSGFAEVVRMEQDKAEWGFKALKQTVKLYYRLGRYKEMMEAYREMLTYIKSAVTRNYSEKCINSIMDYVSGSASQNFGLLQEFYQTTLRALEEAKNERLWFKTNLKLCKIFFDIGEYGRMSKILKELHRSCQREDGTDDHKKGTQLLEVYAIEIQMYTETKNNKKLKQLYQKALTIKSAIPHPRIMGIIHECGGKMHMAERQWADAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERSDRSKGMKKYTAVDKWNTQLKSLYQTINNRVG

SEQ ID NO: 6796 - protein, 430 aa, Tripterygium wilfordii
YGFEYSDEEPEEQDVDIENQYYNSKGLVETDPEGALAGFAEVVSMEPEKAEWGFKALKQTVKLYYRLGKYKEMMNAYREMLTYIKSAVTRNYSEKCINNIMDFISGSASQNFGLLQEFYQTTLWALEEAKNERLWFKTNLKLCKIWFDMGEYGRMSKILKELHKSCQKEDGTDDQKKGSQLLEVYAIEIQMYTETKNNKKLKQLYQKALAIKSAIPHPRIMGIIRECGGKMHTAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVEQLLVSLILDNRIDGHIDQVNRLLERGDRSKGMKKYTAIDKWNTQLRSLYQTVSNRIY

SEQ ID NO: 6797 - protein, 437 aa, Valeriana officinalis
MGSDMEDYGFEYSDEEAEEQDVDIENQYYNSKGLVETDPEEALSGFAEVVRMEPDKAEWGFKALKQTVKLYYRLGKYKEMMEAYREMLTYIKSAVTRNYSEKCINSIMDFVSGSASQNFNLLQEFYQTTLKALEEAKNERLWFKTNLKLCKIWFDMGEYGRMSKILKQLHKSCKKEDGSDDQKKGTQLLEVYAIEIQMYTETKNNKKLKQLYLAALSIKSAIPHPRIMGIIRECGGKMHMAERQWAEAATDFFEAFKNYDEAGNQRRIQCLKYLVIANMLMESEVNPFDGQEAKPYKNDPEVLAMTNLIGAYQRNEIIEFEKILKSNRRTIMDDPFIRNYIEDLLKNVRTQVLLKLIKPYTRIRIPFISKELNVPEKDVEELLVSLILDNRIHGHIDQVNRLLERGDRSKGMKKYTAIEKWNTQLRSLYQTVGNRVC

SEQ ID NO: 6798 - protein, 220 aa, Abies balsamea
MGSDADMEDYGFEYSEEETEEQDVDIENQYYNSKGLVESDPQGALAGFAEVVRMEPEKAEWGFKALKQTVKLYYRLGKYKEMMESYRVMLTYIRSAVTRNYSEKCINNIMDFVSGSASQNFDLLQEFYQTTLKALEEAKNERLWFKTNLKLCKIFFDMGEYGRMNKILKELHKSCRREDGSDDQKKGTQLLEVYAIEIQMYTETKNNKKIEATVPKGSFY

SEQ ID NO: 6799 - protein, 440 aa, Papaver somniferum
MGSDAEMEDYGFEYSEEEPEEQDVDIENQYYNSKGLVETDPEGALEGFSEVVQMEPDKAEWGFKALKQTVKLYYRLGKYKEMMESYREMLTYIKSAVTRNYSEKCINNIMDFVSGTASQNFDLLQEFYQTTLRALEEAKNERLWFKTNLKLCKIWFDMGEYGRMNKILKELHKSCRKEDGTDDQKKGTQLLEVYAIEIQMYTETKNNKKLKQLYQKALSIKSAIPHPRIMGIIHECGGKMHMAERQWAEAATDFFEAFKNYDEAGNQRRIQCLKYLVLANMLMESEVNPFDAQEAKPYTNDPEILAMTNLIAAYQRNEILEFEKILKSNRRTIMDDPFIRNYIEDLLKNIRTQVLLKLIKPYTRIRIPFISKELNVPEKDVEQLLVSLILDNRVQGHIDQVNRLLERSDRSKGIKTYAAIEKWNTQLKVLYQTINNRVGC

SEQ ID NO: 6800 - protein, 439 aa, Allium cepa
MDSDADMEDYGFEYSEDEPEEQDVDIENQYYNSKGLVETDPEAALTGFSEVVSMESEKAEWGFKALKQTVKLYYRLGKYKEMMEAYREMLTYIKSAVTRNYSEKCLNNIMDFVSGPTSQNFNLLQEFYQTTLNALEEAKNERLWFKTNLKLCKIWFDMGEYGRMNKILKELHKSCRKEDGSDDHKKGTQLLEVYAIEIQMYTETKNNKKLKQLYQKALTIKSAIPHPRIMGIIRECGGKMQMAERQWGEAATDFFEAFKNYDEAGNHRRIQCLKYLVLANMLMQSEVNPFDGQEAKPYKNDPEILAMTNLIAAYQRNDILEFEKILKSNRKTIMDDPFIRNYIEDLLKNIRTQVLLKLIKPYTRIRIPFISKELNVPEKDVEQLLVSLILDNRVQGHIDQVNRLLERGDKSKGMKKYTAIDKWNTQLKSLYQTINNRVA

SEQ ID NO: 6801 - protein, 439 aa, Solanum phureja
MGSDADMEDYGFEYSEEEPEEQDVDIENQYYNSKGLAETDPEAALEGFAEVVHMEPEKADWGFKALKQTVKLYYKLGKYKEMMDAYREMLTYIKSAVTRNYSEKCINNIMDFVSGSASQNFDLLQEFYQTTLKALEEAKNERLWFKTNLKLCKIWFDIWEYGRMNKILKQLHKSCQKEDGTADQKKGTQLLEVYAIEIQMYTETKNNKKLKELYTKALSVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLRNVRTQVLLKIIKPYTRIRIPFISKELNVPENDVEELLVSLILDNRIHGHIDQVNRLLECGDRSKEMKKYAAIDKWNTQLRSLYQTVGNRVC

SEQ ID NO: 6802 - protein, 439 aa, Solanum lycopersicum
MGSDADMEDYGFEYSDEEQEEQDVDIENQYYNSKGMVETDPKGALEGFAEVVHMEPEKAEWGFKALKQTVKLYYKLGKFKEMMDSYREMLTYIKSAVTRNYSEKCINGIMDFVSGSASQNFSLLQEFYQTTLKALEEAKNERLWFKTNLKLCKIWFDMGEYGRMSKILKELHKSCKKEDGTDDEKKGTQLLEVYAIEIQMYTETKNNKKLKELYNKALSVKSAIPHPRIMGIIRECGGKMHMAERKWAEAATDFFEAFKNYDEAGNHRRIQCLKYLVLANMLMESEVNPFDGQEAKPYKNDPEILAMTNLIAAYQRNEILEFEKIIKSNRRTIMDDPFIRNYIEDLLRKVRTQVLLKLIKPYTRIRIPFISKELNVPEKDVEDLLVSLILDNRIDGHIDQVNGLLECRDRSKGMKKYTAIDKWNTQLRSLYQTVGNKVC

SEQ ID NO: 6803 - protein, 439 aa, Vinca minor
MGSDVDMEDYGFEYSDEEPEEQDVDIENQYYNSKGMVETDPEAALEGFAEVVRMEPNKADWGFKALKQTVKLYYKLGKYEEMMEAYRNMLTYIKTAVTRNYSEKCINNIMDFVSGSASQNFSLLQEFYQTTLKALEEAKNERLWFKTNLKLCKIWFDMGEYGRMNKILKELHKSCQKEDGTDDQKKGTQLLEVYAIEIQMYTATKNNKKLKQLYQKALSIKSAIPHPRIMGIIRECGGKMHMAERQWAEAATDFFEAFKNYDEAGYQRRIQCLKYLVLANMLMESQVNPFDGQEAKPYKNDPEILAMTNLIAAYQRNEILEFEKILRSNRRTIMDDPFIRNYIEDLLKNVRTQVLLKLIKPYTRIRIPFISKELNVPEKDVEELLVSLILDNRIHGHIDQVNRLLERGDSSKGMKKYAAVDKWNTQLRSLYQTVSNRIC

SEQ ID NO: 6804 - protein, 282 aa, Pinus taeda
MGEYGRMNKILKELHKSCRREDGSDDQKKGTQLLEVYAIEIQMYTETKNNKKLKQLYQKALSIKSAIPHPRIMGIIHECGGKMHMAERQWAEAATDFFEAFKNYDEAGNHRRIQCLKYLVLANMLMESEVNPFDGQEAKPYKNDPEILAMTNLVAAYQRNEILEFEKILKSNRRTIMDDPFIRNYIEDLLKNIRTQVLLKLIKPYTRIRIPFISKELNVPEKDVEQLLVSLILDNRVHGHIDQVNQLLELGDRSKGLKKYVAIDKWNTQLRSLYQTVTNKMG

SEQ ID NO: 6805 - protein, 439 aa, Artemisia annua
MGSDADMEDYGFEYSEEEQEEQDVDIENQYYNSKGLVETDPEGALTGFAEVVQMEPEKAEWGFKALKQTVKLYYRLGRYKEMTDAYREMLTYIKSAVTRNYSEKCINNIMDFVSGSASQNFGLLQDFYQTTLKALEEAKNERLWFKTNLKLCKIYFDMGEYGKMNKILKELHKSCQKADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDLFIRNYIEDLLKNIRTQVLLKLIKPYTRIRIPFISKELNVPEADVEQLLVSLILDNRVQGHIDQVNRLLECGDRSKGIKKYTAVEKWNTQLRSLYQSVSNRVG

SEQ ID NO: 6806 - protein, 407 aa, Pennisetum glaucum
SKGMVETDPEGALAGFDQVVKMESEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQKEDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPERDVEQLLVSLILDNRIQGHIDQVNKLLERGDRSKGMRKYNAIEKWNTQLKTIYQTVSNRVG

SEQ ID NO: 6807 - protein, 439 aa, Quercus alba
MASDADMEDYGFEYSEEEQEEQDVDIENQYYNAKGLVETDPEGALAGFAEVVGMEAEKAEWGFKALKQTVKLYYRLGKYAEMMQAYREMLTYIKSAVTRNYSEKCINNIMDFISGSASQNSGLLQEFYQTTLKALEEAKNERLWFKTNLKLCKIWFDMGEYGRMNKILKELHKSCRKEDGTDDHKKGTQLLEVYAIEIQMYTETKNNKKLKQLYQQALMIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEIFEFEKILKSNRRTIMDDPFIRNYIEDLLKNIRTQVLLKLIKPYTRIRIPFISKELNVPEQDVEQLLVSLILDNRIHGHIDQVNRLLERWDRSKGTKKYTAVDKWNTQLKSLYQTINNRVS

SEQ ID NO: 6808 - protein, 439 aa, Solanum phureja
MGSDADMEDYGFEYSDEEQEEQDVDIENQYYNSKGMVETDPKGALEGFAEVVHMEPEKAEWGFKALKQTVKLYYKLGKFKEMMDSYREMLTYIKSAVTRNYSEKCINGIMDFVSGSASQNFGLLQEFYQTTLKALEEAKNERLWFKTNLKLCKIWFDMGEYGRMSKILKELHKSCKKEDGTDDEKKGTQLLEVYAIEIQMYTETKNNKKLKELYNKALSVKSAIPHPRIMGIIRECGGKMHMAERKWAEAATDFFEAFKNYDEAGNHRRIQCLKYLVLANMLMESEVNPFDGQEAKPYKNDPEILAMTNLIAAYQRNEILEFEKIIKSNRRTIMDDPFIRNYIEDLLRKVRTQVLLKLIKPYTRIRIPFISKELNVPEKDVEDLLVSLILDNRIDGHIDQVNGLLECRDRSKGMKKYTAIDKWNTQLRSLYQTVGNKVS

SEQ ID NO: 6809 - protein, 301 aa, Phalaenopsis aphrodite
MRGCGFKTKFETLVKIWFDVGEYGKMNKILKELHKSCQREDGTDDHKKGTQLLEVYAIEIQMYTETKNNKKLKQLYQKALSIKSAIPHPRIMGIIHECGGKMHMAERQWADAATDFFEAFKNYDEAGNHRRIQCLKYLVLANMLMESEVNPFDGQEAKPYKNDPEILAMTNLIAAYQRNEIFEFEKILKSNRKTIMDDPFIRNYIEDLLKKIRTQVLLKLIKPYTRIRIPFISKELNVPEKDVEQLLVSLILDNRIQGHIDQVNRLLERSDRSKGMKKYAAVDKWNTQLRSLCKTISNRVG

SEQ ID NO: 6810 - protein, 439 aa, Fragaria vesca
MGSDADMEDYGFEYSDEEPEEQDVDIENQYYNSKGLVETDPEEALSGFQEVIRMEPEKAEWGFKALKQTVKIHYRLGRYKEMMDSYREMLTYIRSAVTRNYSEKCINNIMDFVSGSASQNSGFLQEFYQTTLKALEEAKNERLWFKTNLKLCKIWFDMSEYGRMSKILKELHKSCQKEDGTDDQKKGSQLLEVYAIEIQMYTETKNNKKLKQLYQKALAIKSAIPHPRIMGIIRECGGKMHMAERQWAEAATDFFEAFKNYDEAGNQRRIQCLKYLVLANMLMQSEVNPFDGQEAKPYKNDPEILAMTNLVAAYQRNEILEFEKILKSNRKTIMDDPFIRNYIEDLLKNIRTQVLLKLIKPYTRIRIPFISKELNVPEKDVEQLLVSLILDNRIDGHIDQVNQIMERGDRSKGRKKYAAIDKWNTQLKSLSQTIGNRVY

SEQ ID NO: 6811 - protein, 209 aa, Plantago ovata
MGSDADMEDYGFEYSDDEPEEQDVDIENQYYNSKGLVETDPEEALEGFREVVRMEPEKAEWGFKALKQTVKLYYKLGKYKEMMDAYRDMLTYIKSAVTRNYSEKCINGLMDFISVSASQNFSLLQEFYENTLKALEEAKNERLWFKTNLKLCKIWFDIGEYGRMSKILKELHKSCQKEDGTDDQKKGTQLLEVYAVEIQMYTETKNNKS

SEQ ID NO: 6812 - protein, 433 aa, Helianthus annuus
MEDYGFEYSEEEPEEQDVDIENQYYNSKGLVETDPEGALSGFAEVVQMEPEKAEWGFKALKQTVKLYYRLGRYKEMTDAYREMLTYIKSAVTRNYSEKCINSIMDFVSGSASQNFGLLQEFYQTTLKALEEAKNERLWFKTNLKLCKIYFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNRVQGHIDQVNRLLECGDRSKGMKKYTAVEKWNTQLRSLYQSVGNRVG

SEQ ID NO: 6813 - protein, 439 aa, Aquilegia formosa
MGSDADMEDYGFEYSEEEPEEQDVDIENQYYNSKGLVETDPEGALTGFSEVVSMEPEKAEWGFKALKQTVKLYYRLGRFKEMMEAYKEMLTYIKSAVTRNYSEKCISNILDFVSGSASQNFGLLEEFYQSTLKALEEAKNERLWFKTNLKLCKIWFDMGEYGRMNKILKELHKSCRKEDGSDDQKKGTQLLEVYAIEIQMYTETKNNKKLKQLYQKALSIKSAIPHPRIMGIIHECGGKMHMAERQWEEAATDFFEAFKNYDEAGNQRRIQSLKYLVLANMLMESTVNPFDGQEAKPYKNDPEILAMTNLIAAYQRNEILEFEKILKSNRKTIMDDPFIRNYIEDLLKKIRTQVLLKLIKPYTRIRIPFISKELNVPENDVEQLLVSLILDNRVHGHIDQVNRLLERGDSSKGMKKFAAIDKWNTQLRSLYQTVSTRIA

SEQ ID NO: 6814 - protein, 432 aa, Silene vulgaris
EDYGFEYSDDDADEFDVDIENQYYNSKGLVETDPEGALAGFAEVVSMEPEKADWGFKALKQTVKLYYKLGRYKEMMEAYREMLTYIKSAVTRNYSEKCINSIMDFVSGSASHNFDLLQEFYQTTLIALEEAKNERLWFKTNLKLCNIWFDMGEYGRMNKILKELHKSCQKEDGTDDQKKGTQLLEVYAIEIQMYTETKNNKKLKQLYQKALTVKSAIPHPRIMGIIHECGGKMHMAERQWAEAATDFFEAFKNYDEAGNARRIQCLKYLVLANMLMESEVNPFDGQEAKPYKNDPEILAMTNLIAAYQRNEILEFEKILKSNRRTIMDDPFIRNYIEDLLKNIRTQVLLKLIKPYTRIRIPFISKELNVPEQDVEQLLVSLILDNRVQGHIDQVNKLLERSDRSKGLKKYTAIDKWNTQLKSLYQTVNNRVG

SEQ ID NO: 6815 - protein, 439 aa, Glycine max
MASDADMEDYGFEYSDEEEVEQDVDIENQYYNSKGMVESDPEGALAGFAQVVQMEQEKAEWGFKALKQTVKLYYRLGRYKEMMEAYREMLTYIKSAVTRNYSEKCINSIMDYVSGSASQNFGLLQEFYQTTLRSLEDAKNERLWFKTNLKLCKIYFDIGEYGRMNKILKELHKSCQKEDGTDDHKKGTQLLEVYAVEIQMYTETKNNKKLKQLYQKALTIKSAIPHPRIMGIIHECGGKMHMAERQWAEAATDFFEAFKNYDEAGSQRRIQCLKYLVLANMLMESEVNPFDGQEAKPYKNDPEILVMTNLIAAYQRNEILEFEKILKSNRRTIMDDPFIRNYIEDLLKNIRTQVLLKLIKPYTRIRIPFISKELNVPEHDVEQLLVSLILDNRIQGHIDQVNRLLERADRSKGMKKYTAVDKWNTQLKSLYQTINNRVC

SEQ ID NO: 6816 - protein, 433 aa, Cephalotaxus harringtonia
MEDYGFEYSEEETEEQDVDIENQYYNSKGLVESDPQEALAGFSEVVRMESEKAEWGFKALKQTVKLYYRLGKYKEMMDAYREMLTYIKSAVTRNYSEKCINNIMDFVSGSASQNFELLQEFYQTTLRALEEAKNERLWFKTNLKLCKIWFDMGEYGRMNKILKELHKSCRREDGSDDQKKGTQLLEVYAIEIQMYTETKNNKKLKQLYQKALSIKSAIPHPRIMGIIHECGGKMHMAERQWAEAATDFFEAFKNYDEAGNHRRIQCLKYLVLANMLMESEVNPFDGQEAKPYKNDPEILAMTNLVAAYQRNEILEFEKILKNNMKTIMEDPFIRNYIEDLLKNIRTQVLLKLIKPYTRIRIPFISKELNVPEKDVEQLLVSLILDNRVHGHIDQVNQLLELGDRSKGLKKYVAIDRWNTQLRTLYQTVTNRVG

SEQ ID NO: 6817 - protein, 81 aa, Vaccinium corymbosum
MASDADMEDYGFEYSDDEPEEQDVDIENQYYNSKGLVETDPEGALAGFAEVVQMEPEKAEWGFKALKQTVKLYYRLGKHKE

SEQ ID NO: 6818 - protein, 439 aa, Glycine max
MASDADMEDYGFEYSDEEQEEQDVDIENQYYNSKGMVESDPEGALAGFAQVVQMEQEKAEWGFKALKQTVKLHYRLGRHKEMMKAYREMLTYIKSAVTRNYSEKCINSIMDYVSGSASQNFGLLQEFYQTTLRSLEEAKNERLWFKTNLKLCKIYFDIGEYGRMSKILKELHKSCQKEDGTDDHKKGTQLLEVYAVEIQMYTETKNNKKLKQLYQKALTIKSAIPHPRIMGIIHECGGKMHMAERQWADAATDFFDAFKNYDEAGSQRRIQCLKYLVLANMLMESEVNPFDGQEAKPYKNDPEILVMTNLIAAYQRNEISEFEKILKSNRRTIMDDPFIRNYIEDLLKNIRTQVLLKLIKPYTRIRIPFISKELNVPEHDVEQLLVSLILDNRIQGHIDQVNRFLERSDRSKGMKKYTAVDKWNTQLKSLYQTINNRVS

SEQ ID NO: 6819 - protein, 439 aa, Solanum phureja
MGSDADMEDYGFEYSDEDQEEQDVDIENQYYNSKGMVETDPEGALEGFAEVVQMEPEKAEWGFKALKQTVKIYYRLGRYKQMMDAYREMLTYIISAVTRNYSEKCINNIMDFVSGSASQNVGLLREFYETTLKALEEAKNERLWFKTNLKLCKIWFDMGEYGKMNKIMKELHRSCQKADGTDDQKKGTQLLEVYAIEIQMYTETKNNKKLKELYGKALTIKSAIPHPRIMGIIRECGGKMHMAQRQWAEAATDFFEAFKNYDEAGNQRRIQCLKYLVLANMLMESQVNPFDGQEAKPYKNDPEILAMTNLIAAYQRNEILEFEKILKSNRKTIMDDPFIRNYIEDLLKNIRTQVLLKLIKPYTRIRIPFISKEINVPEGEVETLLVSLILDNRIQGHIDQVNKLLEHCDRSKGMKKYTAIDRWNTQFQSLYQTISNKVG

SEQ ID NO: 6820 - protein, 439 aa, Solanum lycopersicum
MGSDADMEDYGFEYSDEDQEEQDVDIENQYYNSKGMVETDPEGALEGFAEVVRMEPEKAEWGFKALKQTVKIYYRLGRFKQMMDSYREMLTYIISAVTRNYSEKCINNIMDFVSGSASQNVGLLREFYETTLKALEEAKNERLWFKTNLKLCKIWFDMGEYGKMNKIMKELHRSCQKADGTDDQKKGTQLLEVYAIEIQMYTETKNNKKLKELYGKALTIKSAIPHPRIMGIIRECGGKMHMAQRQWAEAATDFFEAFKNYDEAGNQRRIQCLKYLVLANMLMESQVNPFDGQEAKPYKNDPEILAMTNLIAAYQRNEILEFEKILKSNRKTIMDDPFIRNYIEDLLKNIRTQVLLKLIKPYTRIRIPFISKEINVPEGEVETLLVSLILDNRIQGHIDQVNKLLEHCDRSKGMKKYTAIDKWNTQFQSLYQTISNKVG

SEQ ID NO: 6821 - protein, 209 aa, Podocarpus macrophillus
MASDADMEDYGFEYSDEETEEQDVDIENQYYNSKGLVESDPQEALAGFAEVVRMESEKAEWGFKALKQTVKLYFRLGKYKEMMEAYREMLTYIKSAVTRNYSEKCINNIMDFVSGTASQNFELLQEFYQTTLKALEEAKNERLWFKTNLKLCKICFDIGEYGRMNKILKELHKSCRKEDGSDDQKKGSQLLEVYALEIQMYTETKITRS

SEQ ID NO: 6822 - protein, 422 aa, Fagus grandifolia
MGSDADMEDYGFEYSEEEQEEQDVDIENQYYNAKGLVETDPKGALAGFSEVVNMEEEKAEWGFKALKQTVKLYYRLGKYEEMMEAYREMLTYIKSAVTRNYSEKCINSIMDFVSGSASQNFGLLQEFYQTTLKALEEAKNERLWFKTNLKLCKIWFDMGEYGRMSKILKELHKSCRKEDGTDDHKKGTQLLEVYAIEIQMYTETKNNKKLKQLYQQALTIKSAIPHPRIMGIIHECGGKMHMAERQWAEAATDFFEAFKNYDEAGNQRRIQCLKYLVLANMLMESEVNPFDGQEAKPYKNDPEILAMTNLIAAYQRNEILEFEKILKNNRRTIMDDPFIRNYIEDLLKNIRTQVLLKLIKPYTRIRIPFISKELNVPEQDVEQLLVSLILDNRIHGHIDQVNRLLERWDRSKGTKKYAAVEK

SEQ ID NO: 6823 - protein, 396 aa, Pseudoroegneria spicata
ALAGFDAVVRMEPEKAEWGFKALKQTVKLYYKLGKYKEMMDAYREMLTYIKSAVTRNYSEKCINNIMDFVSGSASQHFNLLQEFYQTTLKALEEAKNERLWFKTNLKLCKIWFDMGEYGRMSKILKELHKSCQKEDGSDDQKKGTQLLEVYAIEIQMYTETKNNKKLKELYQRALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRVQGHIDQVNKLLECGDRSKGMRKYQAINKWNTQLKSIYQTVSNRVG

SEQ ID NO: 6824 - protein, 439 aa, Ceratodon purpureus
MDSDADMEDYGFEYSDEEPEEQDVDIENQYYNTKGLVEADPEGALRGFSEVVKMEGEKGEWGFKALKQTVKLHYRIGNYKEMMDAYREMLTYIKSAVTRNYSEKCINNILDFVSNGANQNLELLQEFYQTTLKALEEAKNERLWFKTNLKLCKLWFDMGEYGRMNKILKELHKSCQKEDGTDDQKKGTQLLEVYAIEIQMYTETKNNKKLKQLYLKALNIKSAIPHPRIMGIIHECGGKMNMAERQWAVAATDFFDAFKNYDEAGTHRRIQCLKYLVLANMLMESEVNPFDAQEAKPYKNDPEILAMTNLVAAYQRNEILEFEKILKSNRKTIMDDPFIRNYIEDLLSKIRTQVLLKLIKPYTRIRIPFISKELNIPEKDVEQLLVSLILDNRVHGHIDQVNQLLELGDRSKGLRKYTAIDTWNTQLKSLSQTVTARIG

SEQ ID NO: 6825 - protein, 430 aa, Citrus sinensis
MWIYIFFLFSDEFTVSRVLCSILEKGLVETDPEGALAGFAEVVAMEPEKAEWGFKALKQTVKLYYRLGKYKEMMDAYREMLTYIKSAVTRNYSEKCINNIMDFVSGSASQNFSLLREFYQTTLKALEEAKNERLWFKTNLKLCKIWFDMGEYGRMSKILKELHKSCQREDGTDDQKKGSQLLEVYAIEIQMYTETKNNKKLKQLYQKALAIKSAIPHPRIMGIIRECGGKMHMAERQWADAATDFFEAFKNYDEAGNQRRIQCLKYLVLANMLMESEVNPFDGQEAKPYKNDPEILAMTNLIAAYQRNEIIEFEKILKSNRKTIMDDPFIRNYIEDLLKNVRTQVLLKLIKPYTRIRIPFISKELNVPEKDVEQLLVSLILDNRIDGHIDQVNRLLERGDRSKGMKKYTAIDKWNSQLRSLYQTVSNRVS

SEQ ID NO: 6826 - protein, 439 aa, Selaginella moellendorffii
MDSDADMEDYGFEYSEEDPEEQDVDIENQYYNSKGFVEADPRGALKGFAEVVKMEEEKGEWGFKALKQTVKVHFRLGTYKEMMDAYREMLTYIKSAVTRNYSEKCINNIMDFVSGTANQNLELLQEFYQTTLKALEDAKNERLWFKANLKLCKLWFDMGEYARMSKILKELHRSCQREDGSDDQKKGTQLLEVYAIEIQMYTETKNNKKLKQLYQKALSIKSAIPHPRIMGIIHECGGKMHMAERHWADAATDFFEAFKNYDEAGAQRRIQCLKYLVLANMLMESQVNPFDAQEAKPYKNDPEILAMTNLVAAYQRNEIFEFEKILKSNRKTIMDDPFIRNYIEDLLKNIRTQVLLKLIKPYTRIRIPFISKELNIPERDVEQLLVSLILDNRVHGHIDQVHQLLELGDRSKGLKKYTAIDKWNTQLRSLCQTVSNRIG

SEQ ID NO: 6827 - protein, 441 aa, Gnetum gnemon
MSSDLDMEDYGFEYSDEEQGEQDVDIENQYYNSKGLIDSEPKEALAGFAEVVKMESEKGDWGFKALKQTVKLYYRLGNYKEMMEVYREMLTYIKSAVTRNTSEKCINNIMDFISGSAGQNFDFLQDFYQTTLKALEEAKNERLWFKTNLKLCKIWFDMGEYGRMSKILKELHKSCRREDGSDDQKKGTQLLEVYAIEIQMYTETKNNKKLKQLYQKALSIKSAIPHPRIMGIIHECGGKMHMAERHWAEAATDFFEAFKNYDEAGNYRRIQCLKYLVLANMLMESEVNPFDGQEAKPYKNDPEILAMTNLVAAYQRNDILEFENILKNNRRTIMDDPFVRNYIEDLLKKIRTQVLLKLIKPYTRIRIPFISKELNVPEKDVEQLLVSLILDNRVHGHIDQVNQLLELGDRSKGLRKYAAIDKWNTQLRSLYQNVSYKMSVY

SEQ ID NO: 6828 - protein, 439 aa, Physcomitrella patens
MDSDADMEDYGFEYSDEEPEEQDVDIENQYYNTKGLVEADPEGAIKGFAEVVRMEGEKGEWGFKALKQTVKLHYRIGNYKQMMDAYREMLTYIKSAVTRNYSEKCINNILDFVSNGANQNLELLQEFYQTTLKALEEAKNERLWFKTNLKLCKLWFDMGEYGRMNKILKELHKSCQKEDGTDDQKKGTQLLEVYAIEIQMYTETKNNKKLKQLYLKALNIKSAIPHPRIMGIIHECGGKMNMAERQWAVAATDFFDAFKNYDEAGTHRRIQCLKYLVLANMLMESEVNPFDAQEAKPYKNDPEILAMTNLVAAYQRNEILEFEKILKSNRKTIMDDPFIRNYIEDLLSKIRTQVLLKLIKPYTRIRIPFISKELNIPEKDVEQLLVSLILDNRVHGHIDQVNQLLELGDRSKGLRKYTAIDKWNTQLKSLSQTVTARIG

SEQ ID NO: 6829 - protein, 439 aa, Physcomitrella patens
MDSDADMEDYGFEYSDEEPEEQDVDIENQYYNTKGLVEADPEGALKGFAEVVRMEGEKGEWGFKALKQTVKLHYRVGNYKQMMDAYREMLTYIKSAVTRNYSEKCINNILDFVSNGANQNLELLQEFYQTTLKALEEARNERLWFKTNLKLCKLWFDMGEYGRMNKILKELHKSCQKEDGTDDQKKGTQLLEVYAIEIQMYTETKNNKKLKQLYLKALNIKSAIPHPRIMGIIHECGGKMNMAERQWAVAATDFFDAFKNYDEAGTHRRIQCLKYLVLANMLMESEVNPFDAQEAKPYKNDPEILAMTNLVAAYQRNEILEFEKILKSNRKTIMDDPFIRNYIEDLLSKIRTQVLLKLIKPYTRIRIPFISKELNIPEKDVEQLLVSLILDNRVHGHIDQVNQLLELGDRSKGLRKYTAIDTWNTQLKSLSQTVTARIG

SEQ ID NO: 6830 - protein, 403 aa, Sesamum indicum
MGSDADMEDYGFEYSDEEPEEQDVDIENQYYNSKGLVETDPEAALEGFAEVVRMEPEKAEWGFKALKQTVKLYYKLGKYKEMMDAYRDMLTYIKSAVTRNYSEKCINNIMDFISGSASQNFGLLQEFYQTTLKALEEAKNERLWFKTNLKLCKIWFDIGEYGRMSKILKELHKSCQKEDGTDDQKKGTQLLEVYAIEIQMYTETKNNKKLKELYQKALSVKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFERILKSNRRTIMDDPFIRNYIEDLLKNVRTQVLLKLIKPYTRIRIPFISKELNVPEKDVEELLVSLILDNRIQGHIDQVNR

SEQ ID NO: 6831 - protein, 439 aa, Physcomitrella patens
MDSDADMEDYGFEYSDEEPEEQDVDIENQYYNTKGLVEADPEGALKGFAEVVRMEGEKGEWGFKALKQTVKLHYRIGNYKQMMVAYREMLTYIKSAVTRNYSEKCINNILDFVSNGANQNLELLQEFYQTTLKALEEAKNERLWFKTNLKLCKLWFDMGEYGLMNKILKELHKSCQKEDGTDDQKKGTQLLEVYAIEIQMYTETKNNKKLKQLYLKALNIKSAIPHPRIMGIIHECGGKMNMAERQWAVAATDFFDAFKNYDEAGTHRRIQCLKYLVLANMLMESEVNPFDAQEAKPYKNDPEILAMTNLVAAYQRNEILEFEKILKSNRKTIMDDPFIRNYIEDLLSKIRTQVLLKLIKPYTRIRIPFISKELNIPEKDVEQLLVSLILDNRVHGHIDQVNQLLELGDRSKGLRKYTAIDTWNTQLKSLSQTVSARIC

SEQ ID NO: 6832 - protein, 405 aa, Carthamus tinctorius
MGSDADMEDYGFEYSEEEPEEQDVDIENQYYNSKGLVETDPEGALSGFAEVVKMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNRVQGHIDQVNRLL

SEQ ID NO: 6833 - protein, 439 aa, Eutrema halophilum
MASDADMEDYGFEYSDEEQEEQDVDIENQYYNSKGMVETEPEGALSGFAEVVKMEPDKAEWGFKALKQTVKIYYRLGKYKKMMDAYREMLTYIKSAVTRNYSEKCINNIMDFVSGSASQNTGLLQEFYQTTLKALEEAKNERLWFKTNLKLCNIWFDIGEYRRMSKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPEKEVTELLVSLILDNRIDGHIDEMNRYLLRADSANGRKLHKAVDKWNTQLKSLSLSITNRVC

SEQ ID NO: 6834 - protein, 419 aa, Panicum virgatum
ISHRCHLLSSITPPSLASSITPPSSSGSITPPSLTSSIREEGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMNKILKELHKSCQREDGSDDQKKGTQLLEVYAIEIQMYTETKNNKKLKELYQRALSIKSAIPHPRIMGIIRECGGKMHMAERQWAEAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNVPEKDVEQLLVSLILDNRIQGHIDQVNKLLERGDRSKGMRKYNAIDKWNSQLKSIYQTVSNRVG

SEQ ID NO: 6835 - protein, 405 aa, Centaurea maculosa
GLVETDPEGALSGFAEVVKMEPEKAEWGFKALKQTVKLYYRLGRYKEMTDAYREMLTYIKSAVTRNYSEKCINNIMDFVSGSASQNFGLLQEFYQTTLKALEEAKNERLWFKTNLKLCKIWFDMGEYGRMNKILKELHKSCQRADGTDDQKKGTQLLEVYAIEIQMYTETKNNKKLKQLYQKALTIKSAIPHPRIMGIIHECGGKMHMAERQWAEAATDFFEAFKNYDEAGNQRRIQCLKYLVLANMLMQSEVNPFDGQEAKPYKNDPEILAMTNLIAAYQRNEILEFEKILKSNRRTIMDDPFIRNYIEDLLKNIRTQVLLKLIKPYTRIRIPFISKELNVPEADVEQLLVSLILDNRVQGHIDQVNRLLECGDRSKGMKKYTAVEKWNTQLRSLYQSVSNRVG

SEQ ID NO: 6836 - protein, 439 aa, Arabidopsis lyrata
MASDADMEDYGFEYSDEDQEEQDVDIENQYYNSKGMVETEPEEALSGFAEVVQMEPDKADWGFKALKQTVKIYYRLGKYKEMMEAYREMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALSIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLRKVRTQVLLKLIKPYTKIGIPFISKELNVPEKDVTELLVSLILDSRIDGHIDEMNRYLLRGDSGNGRKLHKAVDKWNTQLKSLSSNITSRVC

SEQ ID NO: 6837 - protein, 439 aa, Brassica napus
MASDADMEDYGFEYSDDEPEEQDVDIENQYYSAKGRVEAEPEDALSEFAMVVKMEPDKAEWGFKALKQTVKIYYRLGKYKEMMDAYREMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFEKILKNNRRTIMDDPFIRNYMEDLLKKVRTQVLLKLIKPYTKIKIPFISKELNVPENDVTELLVSLILDSRIDGHIDEINRYLLRGDSANGRKLHKAVDKWNTQLKSLSMSITNRVC

SEQ ID NO: 6838 - protein, 426 aa, Pteridium aquilinum
MGSDADMEDYGFEYSDEEPEEQDVDIENQYYNSKGLVEMDPEGALSGFAEVVRMEGEKGEWGFKALKQTVKLHYRLANFKQMMDAYREMLMYIKSAVTRNYSEKCINNILDFVSGSASQNMELLQEFYQTTLRALEDAKNERLWFKTNLKLCKLWFDMGEYGRMNKILKELHKSCRREDGSDDQKKGTQLLEVYAIEIQMYTETKNNKKLKQLYKQALTIKSAIPHPRIMGIIHECGGKMNMAERQWAEAATDFFDAFKNYDEAGTHRRIQCLKYLVLANMLMESQVNPFDGQEAKPYKNDPEILAMTNLVAAYQRNDILEFEKIIKSNRKTIMDDPFIRNYIEDLLKNIRTQVLLKLIKPYTRIRIPFISQELNIPEKDVEQLLVSLILDNRVHGHIDQVNQLLELGDRSKGPKSIQQLINGTLN

SEQ ID NO: 6839 - protein, 439 aa, Raphanus sativus
  misc_feature (21)..(21): Xaa can be any naturally occurring amino acid
MASDADMEDYGFEYSDEEQEXQDVDIENQYYNSKGNVETDPEEALSGFAEVVKMEPDKAEWGFKALKQTVKIYYRLGKYREMMDAYREMLTYIKSAVTRNYSEKCINSIMDFVSGSASQNTGLLQEFYQTTLTALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLVAAYQRNEIIEFEKILKNNRKTIMDDPFIRNYMEDLLKKVRTQVLLKLIKPYTKIGIPFISKELNVPEKDVTELLVSLILDSRIDGHIDEINRYLLRGDSANGRKLHKAVDKWNTQLKSLSMSITNRVC

SEQ ID NO: 6840 - protein, 433 aa, Eutrema parvulum
MEDYGFEYSDEEQEEQDVDIENQYYNSKGMVETEPEGALSGFAEVVKMEPDKAEWGFKALKQTVKIYYRLGKYKEMMDAYREMLTYIKSAVTRNYSEKCINNIMDFVSGSASQNTGLLQEFYQTTLKALEEAKNERLWFKTNLKLCNIWFEIGEYRRMTKVLKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFEKILKSNRRTIMDDPFIRNYMEDLLKKVRTQVLLKLIKPYTKIGIPFISKELNVPEKDVTELLVSLILDSRIDGHIDEINRYLLRGDSVNGRKLHKAVDKWNTQLKSLSMSITNRVC

SEQ ID NO: 6841 - protein, 439 aa, Brassica juncea
MASDADMEDYGFEYSDEEQEEQDVDIENQYYNSKGMVETEPEEALSGFAEVVKMEPDKAEWGFKALKQTVKIYYRLGKYREMMDAYREMLTYIKSAVTRNYSEKCINSIMDFVSGSAGQNTGLLQEFYQTTLTALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLVAAYQRNEIIEFEKILKNNRKTIMDDPFIRNYMEDLLKKVRTQVLLKLIKPYTKIGIPFISKELNVPEKDVTELLVSLILDSRIDGHIDEINRYLLRGDSANGRKLHKAVDKWNTQLKSLSMSVTNRVC

SEQ ID NO: 6842 - protein, 439 aa, Brassica rapa
MASDADMEDYGFEYSDDEPEEQDVDIENQYYSAKGRVEAEPEDALSEFAMVVKMEPDKAEWGFKALKQTVKIYYRLGKYKEMMDAYREMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMTERQWAEAATDFFEAFKNYDEAGNQRRIQCLKYLVLANMLMESEVNPFDGQEAKPYKNDPEILAMTNLIAAYQRNEIIEFEKILKNNRRTIMDDPFIRNYMEDLLKKVRTQVLLKLIKPYTKIKIPFISKELNVPENDVTELLVSLILDSRIDGHIDEINRYLLRGDSANGRKLHKAVDKWNTQLKSLSMSITNRVC

SEQ ID NO: 6843 - protein, 439 aa, Arabidopsis thaliana
MASDADMEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRVC

SEQ ID NO: 6844 - protein, 439 aa, Unknown
  Sequence found in Organisms: Brassica napus, Brassica rapa
MASDADMEDYGFEYSDEEQEEQDVDIENQYYNSKGNIETEPEEALSGFAEVVRMEPDKAEWGFKALKQTVKIYYRLGKYREMMDAYREMLTYIKSAVTRNYSEKCINSIMDFVSGSAGQNTGLLQEFYQTTLTALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLVAAYQRNEIIEFEKILKNNRKTIMDDPFIRNYMEDLLKKVRTQVLLKLIKPYTKIGIPFISKELNVPEKDVTELLVSLILDSRIDGHIDEINRYLLRGDSANGRKLHKAVDKWNTQLKSLSMSITNRVC

SEQ ID NO: 6845 - protein, 203 aa, Zostera marina
MEDYGFEYSEEEQEEQDVDVENQYYNSKGLLETDPEGALSGFSEVIQMEPEKAEWGFKALKQTVKLYYRLGKYKEMMETYRVMLTYIKSAVTRNYSEKCINNIMDFVSGSASQNFDLLQEFYQTTLKVLEEAKNERLWFKTNLKLCKIWFDMREYGRMNKILKELHKSCQKDDGTDDQKKGHSFWRCMLLRFKCTLKQRITKN

SEQ ID NO: 6846 - protein, 433 aa, Zostera marina
MEDYGFEYSEEEQEEQDVDVENQYYNSKGLLETDPEGALSGFSEVIQMEPEKAEWGFKALKQTVKLYYRLGKYKEMMETYRVMLTYIKSAVTRNYSEKCINNIMDFVSGSASQNFDLLQEFYQTTLKVLEEAKNERLWFKTNLKLCKIWFDMREYGRMNKILKELHKSCQKDDGTDDQKKGTQLLEVYAIEIQMHTETKNNKKLKSLYQKALTIKSAIPHPRIMGIIHECGGKMHMAERHWRQAATDFFEAFKNYDEAGNHRRIQCLKYLVLANMLMGSQVNPFDGQEAKPYKNDPEILAMTNLVAAYQRNEIIEFEKILRSNRRTIMDDLFIRNYIEDLLKNVRTQVLLKLIKPYTRIRIPFIAKELNVQEEEVIQLLVSLILGASIDGHIDQVNGILECGDKSKGSKKYTAVDKWNRQLNSLYIAIASRVC

SEQ ID NO: 6847 - protein, 433 aa, Brassica napus
MEDYGFEYSDEEPEEQDVDIENQYYNSKGNIETEPEEALSGFAEVVRMEPDKAEWGFKALKQTVKIYYRLGKYREMMDAYREMLTYIKSAVTRNYSEKCINSIMDFVSGSAGQNTGLLQEFYQTTLTALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLVAAYQRNEIIEFEKILKNNRKTIMDDPFIRNYMEDLLKKVRTQVLLKLIKPYTKIGIPFISKELNVPEKDVTELLVSLILDSRIDGHIDEINRYLLRGDSANGRKLHKAVDKWNTQLKSLSISITNRVC

SEQ ID NO: 6848 - protein, 319 aa, Malus domestica
MMDAYRVMLTYIKSAVTRNYSEKCINNIMDFVSGSASQNFSLLQEFYQTTLKALEEAKNERLWFKTNLKLCKIWFDMGEYGRMSKILKELHKSCQKEDGTDDQKKGSQLLEVYAIEIQMYTETKNNKKLKQLYQKALAIKSAIPHPRIMGIIRECGGKMHMAERQWADAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLMKPYTRIRFPSYQRNLMCRRKMWSNSWFHLYWITELMDILIR

SEQ ID NO: 6849 - protein, 440 aa, Pinus taeda
MGSDEDEMDYGFEYSDEEQDDEDVAIENQYYNSKGLVESNPQAALSGFADVVRMEPEKDQWGFKALKQTVKLHYRLGNYKEMMDAYREMLTYIKSAVTRNYSEKCLNNIIDFVSGSAGQNIDLLQDFYQTTLKALEEAKNERLWFKTNLKLCKLWFNRGEYGRMNKTVKELHRSCQREDGTDDHKKGTQLLEVYAIEIQMYTETKNNKKLKQLYNKALTVKSAIPHPHIMGIIHECGGKMHTTERQWIEAATDFFEAFRNYDEAGNQRRIQCLKYLVLAYMLMQSEVNPFDAREAKPYKNDPEILAMTNLIAAYQRNEILEFERILKSNRTTIMDDSFIRNHIEDLLKNIRTQVLLKLIKPYTRIRIPFVSKELNIPEKDVEQLLVSLILDNRIPGHIDQVNQLLELGDVRSKGLKKYQAIDKWNTQLHALYQTVACKIG

SEQ ID NO: 6850 - protein, 422 aa, Brassica juncea
MASDADMEDYGFEYSDDEPEEQDVDIENQYYNSKGVVETEPEEALSGFAEVVQMEPDKSEWGFKALKQTVKIYYRLGKYKEMMDAYREMLTYIKSAVTRNYSEKCINNIMDFVSGSASQNTGLLQEFYQTTLTALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLVAAYQRNEIIEFEKILKNNRKTIMDDPFIRNYMEDLLKKVRTQVLLKLIKPYTKIGIPFISKELNVPEKDVTELLVSLILDSRIDGHIDEINRYLLRGDSANGRKLHKAVDK

SEQ ID NO: 6851 - protein, 422 aa, Brassica napus
MASDADMEDYGFEYSDDEPEEQDVDIENQYYTAKGMVEDEPEDALSEFAKVVKMEPDKAEWGFKALKQTVKIYYRLGKYKEMMDAYREMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYQKALAIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEIIEFEKILKNNRRTIMDDPFIRNYMEDLLKKVRTQVLLKLIKPYTKIKIPFISKELNVPEKDVTELLVSLILDSRIDGHIDEINRYLLRGDSANGRKLHKAVDK

SEQ ID NO: 6852 - protein, 383 aa, Lippia dulcis
EKAEWGFKALKQTVKLYYKLGKYKEMMDAYRDMLTYIKSAVTRNYSEKCINNIMDFISGSASQNFSLLQEFYQTTLKALEEAKNERLWFKTNLKLCKIWFDMGEYGRMSKILKELHKSCQKEDGTDDQKKGTQLLEVYAIEIQMYTETKNNKKLKELYQKALSIKSAIPHPRIMGIIRECGGKMHMAERQWAEAATDFFEAFKNYDEAGNQRRIQCLKYLVLANMLMESEVNPFDGQEAKPYKNDPEILAMTNLIAAYQRNEILEFEKILKSNRRTIMDDPFIRNYIEDLLKNVRTQVLLKLIKPYTRIRIPFISKELNVPEKDVQDLLVSLILDNRITGHIDQVNRLLERGDRSKGMKKYTAIDKWNTQFKSLYQTVGNRVC

SEQ ID NO: 6853 - protein, 1193 aa, Zea mays
MDPRRLPILLSLLLAFFSAVVASDEIHGCGGVVEASSGLAKSRKASDSKLDYSDITVELCTVDGLVKESTQCAPNGYYFIPVYDKGSFMVRVKGPKGWSWKPETVPVIIDHNGCNGNADINFQFTGFMISGKVVGAVGGKSCSKRGGPAGVKIELMTDSDELIASALTSSSGEYSFTNIIPGRYILRASHPDYEIELRGSPEIDLRFGNAVADDVFFVSGYDIYGTVVAQGNPIVGVHLYLYSNDVTKVPCPQGFSDAPKEGALCHAISGADGKFTFRSLPCGSYELLPYYKGENTVFDISPSSLSVSVEHSHLTIPQKFQVTGFSVGGRVIDGYGAGVESANVIVDGQLRAITDSLGYYRLDQVTSKKYTITAEKDHYKFNRLEDFMILPNLASIDDIRSVRYDVCGIVRTVTLNSKAMVTLTHGPENVKPQRKLVGENGHFCFEVPAGEYQLSALPVDSERSSSLMFSPGSISVNVNSPLLDLEFSQSQVNVHGKVSCKQQCSQNILVSLVRLAGGVEQEKKTTTLEQDNVNFVFKKVFPGKYRVEVKNSLPEGLAKDDWCWDQSILNIDVGTDDVRDIVFVQKGYWIELVSTHDTNAYIQQPDSSRLDLLIKKGSQRICVETSGQHEIHLTNPCISFGTSSVLFDTANLMPIHINAKKYLVKGEIHVDMSSIQENIDSKDIVVDILKSDGSFIEKISTSLVLGKDNQNDFTAFEYSIWADLGEDFIFVPHDSSIGRNKVLFYPARQQYSVSMNGCQDTVPLITARTGLYLEGSVLPATSDVDIKILAAGKSNYAHLNKGDVATEAKTDSEGSFFAGPLYDDIVYKVEASKDGYHLKQTGPYTFSCQKLGQILVRIYGENSELLPSVLLSLSGEKGYRNNSISSSGGTFTFDNLFPGSFYLRPLLKEYKFNPSAVAIDLNSGESREAEFRATRVAYSAMGSVTLLTGQPKEGVFVEARSESTGFYEEATTDSFGRFRLRGLVPGSTYSIRVAAKDNLQFAAVERASPEYLSVNVGHEDMTGIDFVVFERPEVTILSGHVEGDGIDTLHPHLSVEIRSATDSSRVEAVLPLPLSYYFEVRDLPKGKHLVQLRSGLPSHTHRFESELVEVDLEKDPQIHVGPLKYKTEERHQKQELTPAPVFPLIVGVSVVALVISMPRLNDLYQSAVGMTSLGSGMAPTKKEPRKNILRKRV

SEQ ID NO: 6854 - protein, 1193 aa, Setaria italica
MDTRRFPVLLSLLLAFCSVAAASDEIHGCGGFVEASSGLAKSRKASDSKLDYSDITVELCTVEGLVKESTQCAPNGYYFIPVYDKGLFMVRVKGPKGWSWKPDTVPVVIDHNGCNGNADINFQFTGFMISGKVVGAVGGKSCSKGGGPSGVKVELMTDSDELVASALTSSSGEYSFTNIIPGRYRLRASHPDYDIELRGSPEVDLRFGNVVADDVFFVSGYNIYGTVVAQGNPILGVHLYLYSNDVTEVPCPQGFGDAPREGALCHAISGADGKFMFRSLPCGSYELLPYYKGENTVFDISPSSLPVSVEHGHLTVPQKFQVTGFSVGGRVVDGYGAGVEGANVIVDGQSRAVTDSFGYYRLDQVTSKKYTITAEKDHYKFNRLENFMILPNLASIDDIRSVRYDVCGIVRTVTPNSKAMVTITHGPENVKPQRKLVGENGQFCFEVPTGEYQLSALPVDSERSSSLMFSPGSITVNVNGPLLDLAFSQSQVNVHGKVLCKEECNQNVLVSLVRLAGGVEQEKKTTTLEQDNVNFVFTKVFPGKYRIEVRHSSSEGSVKDVWCWDQNALNVDIGIDDVKDIVFVQKGYWIELVSTHDTEAYIQLPDSSKRDLSIKKGSQRICVETSGQHEIHLTNPCISFGSSSVLFDTANPMPVHINAKKYLVKGEIHVDMGSLQEDIDSKDIVVDVLKSDGSFVEKISTKPALGKSNQNDFTAFEYSIWADLGEDFIFVPHDSSTGRKKVLFYPARQQYSVSVNGCQDTVPQITAKAGLYLEGSVSPATSDVDIRILSAGKSNYAHLNKGDVATETKTDSDGSFFAGPLYNDIEYKVEASKDGYHLKQTGLYTFACQKLGQISVQIYGENLELLPSVLLSLSGEEGYRNNSISGSGGTFIFDNLFPGSFYLRPLLKEYKFNPSAVAIDLNSGESREAEFRATRVAYSAMGSVTLLTGQPKEGVFVEARSESTGYYEEATTDAFGRFRLRGLVPGSTYSIRVVAKDNLQFAAVERASPDYVSVDVGHEDITGIDFVVFERPEVTILSGHVEGDGIDMLQPHLSVEIRSAAEPSRVESVLPVPLSYYFEVRDLPKGKHLVQLRSGLPSHTHRFESELVEVDLEKQPQIHVGPLKYKTEERHQKQELTPAPVFPVIVGVSVIALVISMPRLKDLYQSAVGITSLGSGAAPIKKEPRKNIIRKRV

SEQ ID NO: 6855 - protein, 1193 aa, Panicum virgatum
MDPRRLPVLVVLLLVFFSAAAASDEIHGCGGFVEASSGLAKSRKASDSKLDYSDITVELCTADGLVKESTQCAPNGYYFIPVYDKGSFVVRVKGPKGWSWKPETVPVVIDQNGCNGNADINFQFTGFMISGKVVGPVGGKSCSKRGGPSGVKVELLTDSDELVASALTSSSGEYSFTNIIPGRYRLHASHPDYDIELRGSPEVDLRFGNVVADDVFFVSGYNIYGTVVAQGNPILGVHLYLYSNDVTEVPCPQDFSDAPREGALCHAISGADGKFMFRSLPCGSYELLPYYKGENTVFDISPSSLPVSVEHGHMTISQKFQVTGFSVGGRVVDGYGAGVEGANVIVDGQLRAVTDSLGYYRLDQVTSKKYTITAEKDHYKFNRLENFMILPNLASIHDIRSVRYDVCGIIRTVTPNSKAMVTITHGPENVKPQRKLVGENGRFCFEVPAGEYQLSALPVDSERSSSLMFSPGSISVNVNSPLLDLAFSQSQVNVHGKVSCKEECNQNVLVSLVRLAGGVEQEKETTTLEQDNVNFVFTKVFPGKYRIEVKYSSSEGSTKDDWCWDQNTLNVDIGTDDVRDIVFVQKGYWIELVSTHDTEAYIQLPDSSKLDLSIKKGSQRICVETSGQHEIHLTNPCISFGSSSVLFDTANPMLVHISAKKYLVKGEIHVDVGSLQENIDSKDIVVDVLKSDGSFVEKISIKPALGKSNQNGFASFEYFIWADLGEDFIFVPHDSSTGRKKVLFYPARQQYSVSVNGCQDTVPQITAKTGLYLEGSVSPATSDVDVKILSAGKSSYTHLNKGDVATETKTDSDGSFFAGPLYDDIEYKVEASKDGYHLKRTGPYTFACQKLGQISVRIYGENSELLPSVLLSLSGEEGYRNNSISSSGGTFIFDNLFPGSFYLRPLLKEYKFNPSAVAIDLNSGESRETEFRATRVAYSAMGSVTLLTGQPKEGVFVEARSESTGYYEEATTDSFGRFRLRGLVPGSTYSIRVAAKDNLQFAAVERASPDYLSVDVGHEDITGIDFVVFERPEVTILSGHVEGDGIDMLQPHLSVEIRSAAEPSRVESVLPVPLSYYFEVRDLPKGKHLVQLRSGLPSHTHRFESELVEVDLEKQPQIHVGPLKYKTEERHQKQELTPAPVFPLIVGVSVIALVISMPRLKDLYQSAVGMTSLGSGVAPTKKEPRKNIIRKRV

SEQ ID NO: 6856 - protein, 1164 aa, Pennisetum glaucum
GGFVEASSGLAKSRKASDSKLDYSDITVELCTVDGLVKESTQCAPNGYYFIPVYDKGSFMVRVKGPKGWSWKPETVPVVIDHSGCNGNADINFQFTGFMISGKVVGAVGGKSCSKRGGPSGVKVELMTDSDELVASALTLSSGEYSFTNIIPGRYRLRASHSDYDIKLRGSPEVDLRFGNVVADDVFFVSGYNIYGTVVAQGNPILGVHLYLYSNDVTGVPCPQGFGDAPREGALCHAISGADGKFVFKSLPCGSYELLPYYKGENTVFDISPSSLPVSIEHGHLTVPQKFQVTGFSVGGRVVDGYGAGVEGANVIVDGQSRAVTDSSGYYRLDQVTSKKYTITADKDHYKFDRLENFMILPNLASIDDIRSVRYDVCGIVRTVTPNSKAMVTVTHGPENVKPQRKLVGENGQFCFEVPAGGYQLSALPVDSERSSSLMFSPGSITVNVNGPLLDLAFSQSQVNVHGKVLCKEECNQNVLVSLIRLAGGVEQEKKTATLEQDNVNFVFTKVFPGKYRIEVRHSSSEGSVKDDWCWDQNAMNIDIGINDVKDIVFVQKGYWIELVSTHDTEAYIQLPDSSKRDLSIKKGSQKICVETSGQHEIHLTNPCISFGSSSVLFDTANPMPVYINAKKYLVKGEIHVDMGSLQEDIDSKDIVVDVLKREGSFLEKISTKPALGKSNQNDFTAFEYSIWADLGEDFIFVPHDSGIGRKKVLFYPAKQQYSVSVNGCQDTVPQITAKAGLYLEGSVSPATSDVDIKIISAGKSNYAHLNKGDVATETKTDSDGSFFAGPLYNDIEYKVEASKDGYHLKQTGPYTFACQKLGQISVRIFGENSELLPSVLLSLSGEEGYRNNSISGSGGTFIFDNLFPGSFYLRPLLKEYKFNPSAVAIDLNSGESREAEFRATRVAYSAMGSVTLLTGQPKEDVFVEARSESTGYYEEATTDAFGRFRLRGLVPGSTYSIRVVAKDNLQFAAVERASPDYVSIDVGHEDITGIDFVVFERPEVTILSGHVEGDGIDMLLPHLSVEIRSAAEPSRVESVLPIPLSYYFEVRDLPKGKHLVQLRSGLPSHTHRFESELVEVDLEKQPQIHVGPLKYKTEERHQKQELTPAPVFPLIVGVSVIALVISMPRLKDLYQSAVGMTSLGSGAAPIKKEPRKTMIRKRV

SEQ ID NO: 6857 - protein, 1193 aa, Oryza sativa
MDPRLLLALLCLAAFSAAAYASDEIHGCGGFVEASSGLAKSRKASDSKLDYSDITVELCTIDGLVKESTQCAPNGYYFIPVYDKGSFMVRVKGPKGWSWKPETVPVVIDQNGCNGNADINFQFTGFMISGKVVGAVGGKSCSKHGGPSGVKVELSTNSDELVASALTSSTGEYSFANIIPGRYKLRASHPNYEIETRGSSEVDLRFGNAVADDVFFLSGYNIYGSVVAQGNPILGVHLYLYSNDVTEVPCPQSISDAPREGALCHAVSGADGKFTFSSLPCGSYELLPYYKGENTVFDVSPPSLLVSVEHSHMTIPQKFQVTGFSVGGRVVDGYGAGVEGANVIVDGQLRAVTDNLGYYRLDQVTSKKYTIVAEKDHYKFNRLENFMILPNMASIDDITSVRYDVCGIVRTVTPNSKSMVTLTHGPENVKPQRKLVSENGRFCFEVLAGEYRLSALPVDTEGSSSLMFSPGFIDVNVNSPLLDIEFSQSQVNLHGKVLCKEQCNQNILLSLVRLAGGIEQEKKTVTLEQDNVNFAFKKIFPGKYRLEVKHSSSEAAAQDDWCWDQNAMDINVGSDDVTDIVFVQKGYWVELVSTHETKAYIQHPDSSKLDLLIKKGSQRICIETPGQHELHLINSCISFGSSPVVFDTKNPMPVHISAKKYLVRGELHVEMGSLQEIDLSKNIGVDVFKSDGSFIEKISATPVLGKSYQNDISAFEYSIWAEFGEDFIFVPRDDSTGRKNILFYPSSQQFSVAVNGCQYTVPSITAKTGLYLEGSVSPAISDVDIKILAAGKSKYASLKERDIAMETKTNSEGSFFAGPLYDDIGYTVEASKAGYHLKQTGPYTFSCQKLGQILVRIYGEQDAELLPSVLLSLSGEEGYRNNSISGSGGTFSFGNLFPGSFYLRPLLKEYKFTPSAVAIDLNSGESREVEFRATRVAYSAMGSVTLLTGQPKEGVFVEARSESRGYYEEATTDSFGRFRLRGLVPGSIYSVRVVAKDDHRFAAVERASPEYVSIDVGQDDISGIDFVVFERPESTILSGHVEGDDLDMLQPQLSVEIRSAADPSRIESVLPVPLSYYFEVQNLPKGKHLVQLRSGLPSHTHRFESEIVEVDLDKQPQIHVGPLKYKTEERHHKQELTPAPVFPLIVGVSVIALVISMPRLKDLYQSAVGMTTLGSAAAPIKKEPRKTIMRKRA

SEQ ID NO: 6858 - protein, 1203 aa, Brachypodium distachyon
MDPRVPVLLVLVLSLAAFSAASDEIHGCGGFVEASSGLAKSRKASDSKLDYSDITVELCTVDGLVKESTQCAPNGYYFIPVYDKGSFVVRVKGPKGWSWKPETVPVVIDQNGCNGNADINFQFTGFTISGKIVGAVGGKSCSKDGGPSGVKVELLSDSDELVASALTSSTGGYSFVNIIPGRYKLRASHPDYDIEMRGSSEVDLRFGNVVADDVFFVSGYNIHGSVVAQGNPILGVHLYLYSNDVKEVRCSQGLSDAPREGALCHAVSGADGKFTFRSIPCGSYELLPYYKGESTVFDVSPSSLPVSVEHSHMTIPQKFQVTGFSVGGRVIDGYGAGVEGANLIIDGQLRAVTDNLGYYRLDQVTSKKYTIVAEKNHYKFNVLENFMILPNVASIDDIKSVQYDVCGVVQTVTPNSKAMVTLTHGPENVKPQKKMVSKDGRFCFEVPTGEYRLSALPVDSEGSSSLMFSPGYIDVNVKSPLLDVEFSQSQVNVHGKVLCKEQCNQNILLSLVRLAAGVEQEKKTTSLEQDNVNFVFTKVFPGKYRLEVKHSSSEASENDDWCWDQNTFDIDVGNDDLVDIVFVQKGYWIELVSTHDTAAYIHQPDSSRLDFQPDTSKFDLLIKKGPQRICIETPGHHELHLVNSCISFGSLSTMFDTQNPMPVHISAKKYLVRGEIHVDISSPQEEIDLLEDIVVDAFKNDGSSIKKLSAIPVLGKSHQNGITAFEYSTWTELGDDFIFVPRDSSTGRKKILFYPSEQQFSVSSDGCQDAVPSITAKTGLYLEGSVAPATSDVDIKIVAAGNSKYAPLKKGDVAAETKTNSDGSFFAGPLYDDIGYEVEASKAGYHLKQTGPYSFACQRLGQILARVYGEKDTEMLPSVLLSLSGEGGYRNNSVSGSSGTFSFGNLFPGSFYLRPLLKEYKFTPSTVAIDLNSGESREVEFHATRVAYSAMGSITLLTGQPKEGVFVEARSESRGHYEEATTDSFGRFRLRGLVPGSTYSIRVVAKDNIRSAAVERASPEYVSIDVGQEDISGIDFVVFERPEATILSGHVEGDDIDMLQPHLSIEIRSVLDPSRIVSVVPVPLSYYFELRNLPKGKHLVQLRSGLPSHTHIFESELVEVDLEKQPQIHVGPLKYKTEERHLKQELTPAPVFPLIAGVSIIALVISMPRLKDLYQSAVGRTSLSSGITPSRKEPRKTILRKRA

SEQ ID NO: 6859 - protein, 404 aa, Zea mays
MGPVANDAWQKRFFSVAPPATLVFFFVLIFVAGAIVTLDHKESLAILQLQPRGVIAAEQMRPPATSELRAEPAAEEPDICENKCRPAGSEALPRGIVQDKSNFEMESLGGNPERKEKKGNGRHSKSLLAIPVGIKQKAIVDKLVSKFPDTNFIVMLFHYDGEVDGWRDLEWSGRAIHVGVRDQTKWWFAKRFLHPDLVAEYDYVFLWDEDIEVDSFDPLRYLRVVREERLEISQPALDRRSQIHHRLTARAARSGGVHRRYYKTSGHGRCYGNSTGPPCAGWVEMMVPVFSRAAWRCAWHMIQNDLIYAWGMDYKLGYCAQGDRSRNVGVVDSQYVLHRGIPTLGDGGKATATAAASALGTADRLAVRQRSYTELQLFNRRWKKAVAEDGCWTDPYPNPATTTG

SEQ ID NO: 6860 - protein, 407 aa, Zea mays
MDPVSKGAWQKRFFSVAPPAALVFFFVLIFVAGAAVTLDHKESRVSVLQLQPKLVTAAAEMRPPATTSELRAGPAEEPDICESKCRPPGSEALPRGIVQDKSNLEMESMGGNPEREENGSGRRSKSLLAIPVGIKQKAVVDKLVSKFPDTKFTVMLFHYDGEVDGWRDLEWSGRAVHVAARDQTKWWFAKRFLHPDLVAEYDYVFLWDEDVEVDSFDPLRYLRVVRKEGLEVSQPALDRRSQIHHGLTARARRGGGVHRRYYKTKGHGRCYGNSTGPPCTGWVEMMVPVFSRAAWRCAWRMVQNDLVYAWGMDYKLGYCAQGDRRRNVGIVDSQYVLHRGIPTLGGGGGNGNGKPSFSASASALGADRLAVRQRSYTELQVFNRRWKKAVSEDGCWTDPYPNTATTG

SEQ ID NO: 6861 - protein, 397 aa, Setaria italica
MGPISNDTSHKRFFSIAPRAALIFFVLIFVAGAIFTLDHKENLSILQLQRKEVFATEEIRPPATSELHAEPTEEPNICENQCRPSGSEALPRGIVQDMSNFEMESLGGNPDRRKDRRLSKSLLAIPVGIKQKSVVDKLVSKFPAANFIVMLFHYDGMVDGWRDLKWSDRAIHVAVRDQTKWWFAKRFLHPDLVAEYEYIFLWDEDIEVDSFDPLKYLSIVRREGLEISQPALDRRSLIHHRLTARARKGDVHRRFYKTNGHGRCYGNSTGPPCTGWVEMMVPVFSRAAWRCAWQMIQNDLIYAWGMDYKLGYCAQGDRWRNVGVVDSQYVLHRGIPTLGDGGKATVTASTSTSSATDRLAVRQRSYTELQVFNRRWKEAVAEDGCWTDPYPNPATKG

SEQ ID NO: 6862 - protein, 400 aa, Panicum virgatum
MGPISNDASHKRFFSIAPPAALIFFFVLIFVAGAIVTLDHKENLSILQLHPREAFATEEIRPPATSALRAEPTEEPNLCENQCRPSGSEALPRGIVQDKSNFQMESLGGNPGRKKAVRPSKSLLAIPVGIKQKAVVDKLVAKFPASNFVVMLFHYDGVVDGWRDLKWSDRAIHVAVRDQTKWWFAKRFLHPDLVAEYEYIFLWDEDIEVDSFDPLKYLRIVRREGLEISQPALDRRSQIHHRLTARARNVDVHRRFYKTNGHGRCYGNSTGPPCTGWVEMMVPVFSRAAWRCAWHMIQNDLIYAWGMDFKLGYCAQGDRWRNVGVVDSQYVLHRGIPTLGDGGKAQVSAFTSASASATDRLAVRQRSYTELKVFNRRWKEAVAEDGCWTDPYPDPATTTG

SEQ ID NO: 6863 - protein, 298 aa, Saccharum officinarum
MEASVGVRAPPRGRAWAGLEKPQGAHSVRVPPARLTAERLLPPRKLVLGADPWRTADPALRPAKLRASCSAKSAGTGKVHYSADEALILQQKAQDVLSYLDGRCIYLVGMMGSGKTTVGKILAEVLGYSFFDSDKLVEKAVGISSVAEIFQLHSEAFFRDNESEVLRDLSSMHRLVVATGGGAVIRPINWNYMKKGLTVWLDVPLDALARRIAAVGTASRPLLHQESGDPYAKAYAKLTSLFEQRMDSYANADARVSLEHIALKQGHNDVTILTPSAIAIEALLNMESFLTEKTMVRK

SEQ ID NO: 6864 - protein, 294 aa, Panicum virgatum
MEASVGIRARPGAWAGLEKPRGACSARVPAARLTAEKLPARLALGTDPRRSTDPVLRAAKMKASCCKKSTGTEKVHYSADEALILQQKAQDVLPYLDGRCIYLVGMMGSGKTTVGKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQESGDPYAKAYAKLTSLFEKRMDSYANADARVSLEHIALKQGHNDVTILTPSTIAIEALLKMESFLTEKAMVRN

SEQ ID NO: 6865 - protein, 294 aa, Panicum virgatum
MEASVGIRARPGAWAGLEKPRGAYSARAPPVRLTPEKLPERLALGTGPRRSTDPVLRAAKLKASCCKKSAGTEKVHYSADEALILQQKAQDVLPYLDGRCVYLVGMMGSGKTTVGKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQEYGDPYAKAYTKLTSLFEQRMDSYANADARVSLEHIALKQGHNDVTILTPSTIAIEALLRMESFLTEKATVRN

SEQ ID NO: 6866 - protein, 293 aa, Zea mays
MEAIVGVRAPPRGRAWAGLEKPPRAACRARVPTARLAVAADRPRRLVLLGADTRRAADPALRCAAQSAGGTGKVHYSADDALILQQKAQDVLPYLDGRCVYLVGMMGSGKTTVGKILSEVLGYSFFDSDKLVEKAVGISSVAEIFQLHSETFFRDNESEVLTDLSSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSTIAIEALLKMESFLTEKTMVRN

SEQ ID NO: 6867 - protein, 297 aa, Setaria italica
MEASVGIGARPRIWAGLVEKPHGGAYSARAPALRFTAEKLPQRLVLGTDPWRGTDPGLIRAAKLKASCCKKSAGTEKVHYSADEALILQQKAQDVLPYLDGRCVYLVGMMGSGKTTVGKILAEVLGYSFFDSDKLVEKAVGISSVAEIFQLHSEAFFRDNESEVLRDLSSMHRLVVATGGGAVIRPINWSYMKRGLTVWLDVPLDALARRIAAVGTASRPLLHQESGDPYAKAYAKLTSLFEQRMDAYANADARVSLEHIALKQGHNDVTILTPSTIAVEALLKMENFLSENAMVRN

SEQ ID NO: 6868 - protein, 267 aa, Pennisetum glaucum
VRCTAEKLPRRLVLGTDPWRRSTDPGLLIRAAKLKASCSKKSAGTEKVHYSADEALILQQKAQDVLPYLDGRCVYLVGMMGSGKTTVGKILAEVLGYSFFDSDKLVEKAVGISSVAEIFQLHSEAFFRDNESEVLRDLSSMQRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSAIAIEALLKMESVLSENAMVRN

SEQ ID NO: 6869 - protein, 79 aa, Saccharum officinarum
MCCCGDGGECRPLGWLLGLPFALLAVLVSIVGAIIWIIGLPISCICPCCLCVTVVLEAAVELIKAPLHVMTWFTSKIPC

SEQ ID NO: 6870 - protein, 80 aa, Panicum virgatum
MCCCGGDGGECRPLGWLLGLPFALLAVLVSIVGAIIWIIGLPISCICPCCLCVTLVLEAAVELIKAPLHVMTWFTSKIPC

SEQ ID NO: 6871 - protein, 81 aa, Zea mays
MCCGCGGDGRECRPLGWLLGLPFALLAVLVSVVGAIIWIIGLPISCICPCCLCVTVVLEAAVELIKAPLHVITWFTSKIPC

SEQ ID NO: 6872 - protein, 78 aa, Cynodon dactylon
MCCGGDGECRPLGWLLGLPFALLAILVSIVGAIIWIIGLPISCICPCCLCVTLVLEAAVELIKAPIHVMTWFTSKIPC

SEQ ID NO: 6873 - protein, 78 aa, Saccharum officinarum
MCCCGDGECRPLGWLLGLPFALLAVLVSLVGAIIWIIGLPISCICPCCLCVTVLLEVAVELVKAPLHVMTWFTSKIPC

SEQ ID NO: 6874 - protein, 83 aa, Panicum virgatum
MCCCGGDGGDGGECRPLGWLLGLPFALLAVLVSIVGAIIWIIGLPISCICPCCLCVTLVLEAAVELIKAPLHVMTWFTSKIPC

SEQ ID NO: 6875 - protein, 78 aa, Pennisetum glaucum
MCCCGDGECRPLGWLLGLPFALLAVLVSLVGAIIWIIGLPISCICPCCLCVTLLLEVAVELVKAPLHVMTWFTSKIPC

SEQ ID NO: 6876 - protein, 78 aa, Unknown
  Sequence found in Organisms: Sorghum bicolor, Triticum aestivum
MCCCGDGECRPLGWLLGLPFAVLAVLVSFVGAIIWIIGLPISCICPCCLCVTVLLEVAVELVKAPLHVMTWFTSKIPC

SEQ ID NO: 6877 - protein, 78 aa, Zea mays
MCCGGDGECRPLGWLLGLPFALLAVLVSFVGAVIWIIGLPISCICPCCLCVTVLLEVAVELVKAPLHVMTWFTSKIPC

SEQ ID NO: 6878 - protein, 78 aa, Setaria italica
MCCGGDGECRPLGWLLGLPFALLAVIVSFVGAIIWIIGLPISCICPCCLCVTLLLEVAVELVKAPLHVMTWFTSKIPC

SEQ ID NO: 6879 - protein, 69 aa, Saccharum officinarum
MCCCGDGGECRPLGWLLGLPFALLAVLVSIVGAIIWIIGLPISCICPCCLCETVVLNAAVRSYKGAVAR

SEQ ID NO: 6880 - protein, 77 aa, Panicum virgatum
MCCGDGECRPLGWLLGLPFALLAVIVSFVGAIIWIIGLPISCICPCCLCVTLLLEVAVELVKAPLHVMTWFTSKIPC

SEQ ID NO: 6881 - protein, 87 aa, Oryza sativa
MCCCCGGGGDGDGDGCKCRPLGWLLGLPFALLAVLVSIVGAIIWIIGLPISCICPCCLCVTLVLEAAVELIKAPLHVMTWFTSKIPC

SEQ ID NO: 6882 - protein, 79 aa, Setaria italica
CCGGDDGRECRPLGFLLGLPFAVLAVLVSIVGAIIWIIGLPISCICPCCLCVTLLLEAAVELVKAPLHVMTWFTSKIPC

SEQ ID NO: 6883 - protein, 77 aa, Oryza sativa
MCCCGGDCRPIGWLLGLPFALLAVVVSFIGAIIWIVGLPISCICPCCLCVTVLLEVAVELVKAPLHVMTWFTSKIPC

SEQ ID NO: 6884 - protein, 85 aa, Hordeum vulgare
MCCCCGGGDRDHDHGCRPLGFLLGLPFALLAVLVSIVGAIIWIIGLPISCICPCCLCVTLLLEAAVELVKAPLHVMTWFTSKIPC

SEQ ID NO: 6885 - protein, 85 aa, Secale cereale
MCCCCGGGDRDREHGCRPLGFLLGLPFALLAVLVSIVGAIIWIIGLPISCICPCCLCVTLLLEAAVELVKAPLHVMTWFTSKIPC

SEQ ID NO: 6886 - protein, 85 aa, Triticum aestivum
MCCCCGGGDRDHEHGCRPLGFLLGLPFALLAVLVSIVGAIIWIIGLPISCICPCCLCVTLLLEAAVELVKAPLHVMTWFTSKIPC

SEQ ID NO: 6887 - protein, 78 aa, Avena sativa
MCCCCGGGGGDGNHDRGCRPLGFLLGLPFALLAVLVSIVGAIIWIIGLPISCICPCCLCITLLLEAGGWSSSRRRSMS

SEQ ID NO: 6888 - protein, 87 aa, Brachypodium distachyon
MGCCCCGGGGDRDRDRGCRPLGWLLGLPFALVAVLVSIVGAIIWIIGLPISCICPCCLCVTLLLEVAVELVKAPLHVMTWFTSKIPC

SEQ ID NO: 6889 - protein, 147 aa, Saccharum officinarum
VHTMLEDDVFFAELSKRISLLITDDDEGGADSSVGAQFVPASSAAAPLPGFPSSRAHVPSHQQDWGASLLAPPAYALYHHGASYGGAAAAWQQCGSKGTGVFIPRSTPGSAHPKKKGKNRGAAAAAAKAARAAQQAVGAGVPTKKRV

SEQ ID NO: 6890 - protein, 574 aa, Saccharum officinarum
MASHIILPPDDADENHNHQEAAEEEEREELGRDDDDDDDDEHGPPPGLPPKAALPFSATWVRISRDSYPNLRALRNASSVSLADAAYVKISEGDFGYVLDDVPHFTDYLPDIPTYPNPLQDHPAYSTVKQYFVNEDDTVPQKVVVQKNSRRGVHFRRAGPRQRVYFGTDEVKACIVTCGGLCPGLNTVIRELVCGLSHMYNVSSIFGIQNGYKGFYSSNYLPLTPKSVNDIHKRGGTVLGTSRGGHDTKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYLDGEGGLLEYIEKRLKENKHMVIVVAEGAGQDLIAKSIATSDQQDASGNKLLLDIGLWLTHKIKDYFKSKKMEMTIKYIDPTYMIRAIPSNASDNVYCTLLAHSAIHGAMAGYNFTVGMVNGRHTYIPFYRVTSTRNKVKVTDRMWARLLSSTNQPSFLSQKDIDEASEADRLANRPPLPTGASPRVARSFDQSSSCSSNGEI

SEQ ID NO: 6891 - protein, 575 aa, Zea mays
MASHIILPPDDADENHNHQAAAAAEEEEEERDELGRDDDDDEHGVPPALPPKAALPFSATCVRISRDSYPNLRALRNASSVSLADAAYVKISEADFGYVLDDVPHFTDYLPDIPTYPNPLQDHPAYSTVKQYFVNEDDTVPQKVVVQKNSRRGVHFRRAGPRQRVYFGTDEVKACIVTCGGLCPGLNTVIRELVCGLSHMYNVSSIFGIQNGYKGFYSSNYLPLTPKSVNDIHKRGGTVLGTSRGGHDTKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYLDGEGGLLQYVEKRLKENKHMVIVVAEGAGQDLIAKSLATSDQQDASGNKLLLDIGLWLTHKIKDYFKSKKMEMTIKYIDPTYMVRAIPSNASDNVYCTLLAHSAIHGAMAGYSFTVGMVNGRHTYIPFYRVTSTRNKVKVTDRMWARLLSSTNQPSFLSQKDIDEASEADRLANRPPLPTGASSRVVRSFDQSSSCSSNGEI

SEQ ID NO: 6892 - protein, 1076 aa, Setaria italica
MYRAAGSHLRSLKHHGATRLASTSVVKQSQGGLFGWLLGGKSSQLPPLDVPLPGITIPPPLPDFVEPSKTKITTLPNGVKIASETSASPAVSVGLYIDCGSIYETPASSGVSHLLERMAFKSTVNRSHLRLVREVEAIGGNVSASASREQMSYTYDALKSYTPEMVEVLIDSVRNPAFLDWEVKEQLQKIKSEIAEVSANPQGLLLEALHSAGYSGALAKPLMASESAVNRLDVSILEEFVAEHYTAPRMVLAASGVEHDTLVSVVEPLLSDLPSVKRPEEPKSVYVGGDYRCQADSPSTHIALAFEVPGGWNQEKTAMVVTVLQMLMGGGGSFSAGGPGKGMHSRLYLRILTNYQQIESFSAFNSVYNNSGLFGIYAVTSPDFSSKAVDLAAGELLEIATPGKVSQEQLDRAKEATKSAVLMNLESRSIASEDIGRQVLTYGERKPIEYFLKTVEEITLNDISSTAKKIMSSPLTMASWGDVIHVPSYESVSRKFHSKPRPRTMASHIILPPDDADENHHHPQEDGEEREEELGRDDGDEEREHASPERPPKAALPFSATCVRISRDSYPNLRALRNASSVSLADAAYVKISEGDFGYVLDDVPHLTDYVPDIPTYPNPLQDHPAYSTVKQYFVNEDDTVPQKVVVQKNSRRGVHFRRAGPRQRVYFGPDEVKACIVTCGGLCPGLNTVIRELVCGLSHMYNVNNIYGIQNGYKGFYSSNYLPLTPKSVNDIHKRGGTVLGTSRGGHDTKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYMDGEGGLLQYIERRLKENRHMVIVVAEGAGQDLIAQSIAKSDQQDASGNKLLLDIGLWLTHKIKDYFKSKKMEMTIKYIDPTYMIRAIPSNASDNVYCTLLAHSAIHGAMAGYSFTVGMVNGRHTFIPFYRVTSTRNKVRITDRMWARLLSSTNQPSFLSQKDIDEASEADRLANRPPLPTGASHRVASSFEQSASTSSNGEI

SEQ ID NO: 6893 - protein, 566 aa, Panicum virgatum
MASHIILPPEDADENHHREEEEEEREELGHDGGERAPPEQPPKGALPFSATCVRISRDSYPNLRALRNASSVSLADAAYVKISEGDFGYVLDDVPHLTDYVPDIPTYPNPLQDHPAYSTVKQYFVNEDDTVPQKVVVQKNSRRGVHFRRAGPRQRIYFGPDEVKACIVTCGGLCPGLNTVIRELVCGLSHMYNVNSIFGIQNGYKGFYSSNYLPLTPKSVNDIHKRGGTILGTSRGGHDTKKIVDNIQDRGINQVYIIGGDGTQKGAYDIFKEIRKRSLKVSVAGVPKTIDNDIAIIDKSFGFDTAVEEAQRAIDSAHVEACSAENGIGLVKLMGRYSGFIAMCATLASRDVDCCLIPESPFYMDGEGGLLEYIERRLKENKHMVIVVAEGAGQDLIAKSIAKSDQQDASGNKLLLDIGLWLTHKIKDYFKTKKMEMTIKYIDPTYMIRAIPSNASDNVYCTLLAHSAIHGAMAGYSFTVGMVNGRHTYIPFYRVTSTRNKVKITDRMWARLLSSTNQPSFLSQKDIDEAMEDDRLANRPPLPMGANHRVASSFEQSSSTSSNGEI

SEQ ID NO: 6894 - protein, 569 aa, Panicum virgatum
MASHIILPPEDADENHHREEDGEEEEEREELGHDGGERAPPEQPPKAALPFSATCVRISRDSYPNLRALRNASSVSLADAAYVKISEGDFGYVLDDVPHLTDYVPDIPTYPNPLQDHPAYSTVKQYFVNEDDTVPQKVVVQKNSRRGVHFRRAGPRQRIYFGPDEVKACIVTCGGLCPGLNTVIRELVCGLSHMYNVNSIFGIQNGYKGFYSSNYLPLTPKSVNDIHKRGGTILGTSRGGHDTKKIVDNIQDRGINQVYIIGGDGTQKGAYDIFKEIRKRSLKVSVAGVPKTIDNDIAIIDKSFGFDTAVEEAQRAIDSAHVEACSAENGIGLVKLMGRYSGFIAMCATLASRDVDCCLIPESPFYMDGEGGLLEYIERRLKENKHMVIVVAEGAGQDLIAKSIAKSDQQDASGNKLLLDIGLWLTHKIKDYFKTKKMEMTIKYIDPTYMIRAIPSNASDNVYCTLLAHSAIHGAMAGYSFTVGMVNGRHTYIPFYRVTSTRNKVKITDRMWARLLSSTNQPSFLSQKDIDEAMEDDRLANRPPLPMGANHRVASSFEQSSSTSSNGEI

SEQ ID NO: 6895 - protein, 573 aa, Pennisetum glaucum
MASHIILPPDDAEENHHDYQEEDGEEEELGSDGGEERQRDAAQAEQQPPKAALPFSATCVRISRDSYPNLRALRNASSVSLADAAYVKISEGDYGYVLDDVPHLTDYIPDIPTYPNPLQDHPAYSTVKQYFVNEDDTVPQKVVVQKNSRRGVHFRRAGPRQRIYFGPDEVKACIVTCGGLCPGLNTVIRELVCGLSHMYNVNNIYGIQNGYKGFYSSNYLPLTPKGVNDIHKRGGTVLGTSRGGHDSKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYMDGEGGLLQYIERRLKENKHMVIVVAEGAGQDLIAKSIAASDQQDASGNKLLLDIGLWLTHKIKDYFKGKKMEMTIKYIDPTYMIRAIPSNASDNVYCTLLAHSAIHGAMAGYSFTVGMVNGRHTYIPFYRVTSTRNKVRITDRMWARLLSSTNQPSFLSQKDIDEAREADRLANRPPLPTGASHRVATSFEQSASSTSNGEI

SEQ ID NO: 6896 - protein, 518 aa, Panicum virgatum
MYRAAGSHLRSLKHLGATRLASTSVVKQPQGGLFSWLLGGNSSQLPPLDVPLPGITIPPPLPDFVEPSKTKITTLPNGIKIASEMSPSPAVSVGLYIDCGSIYETPVSSGVSHLLERMAFKSTVNRSHLRLVREVEAIGGNVSASASREQMSYTYDALKNYTPEMVEVLIDSVRNPAFLEWEVKEQLQKIKSEIAEVSVNPQGLLLEALHSAGYSGALAKPLMASESAVNRLDVSILEEFVAEHYTAPRMVLAASGVEHDTLVSVVEPLLSDLPSVKRPEEPKSVYVGGDYRCQADSPSTHIALAFEVPGGWNQEKTAMVVTVLQMLMGGGGSFSAGGPGKGMHSRLYLRVLSNYQQIESFSAFNSVYNNSGLFGIYAVTSPDFSSKAVDLAAGELLEIATPGKVSQEQLDRAKEATKSAILMNLESRSIASEDIGRQVLTYGERKPIEYFLKTVEEITLNDISSTAKKIMSSPLTMASWGDVIHVPSYESVSRKFHSKPHPHPHGVAHHPAAGGRRR

SEQ ID NO: 6897 - protein, 567 aa, Oryza sativa
MASSHIILPPDDDDEEQRRLEEEEDEDPWARSGPPPAAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGFIAMYATLASRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 6898 - protein, 553 aa, Brachypodium distachyon
MASHIILPPDDEEQRQRDEEEDGGQSASEHAPLPFSAMCVRISRDSYPNLRALRNASAVSLADAAYAKISEGDFGYVLDDVPHLADYLPDIPTYPNPLQDHPAYSTVKQYFVNEDDTVPQKVVVQKNSRRGVHFRRAGPRQRVYFESDEVKACIVTCGGLCPGLNTVIRELVCGLSHMYNVNKIYGIQNGYKGFYSSNYLAVTPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAIDSAHVEACSAENGIGLVKLMGRYSGFIAMYATLASRDVDCCLIPESPFYMDGEGGLLQYIEKRLKENKHMVIVVAEGAGQDIIAKSIPSSDQQDASGNKLLLDIGLWLTHKIKDHFKSKKVEMTIKYIDPTYMIRAIPSNASDNVYCTLLAHSAIHGAMAGYSFTVGMVNGRHTYIPFYRVTSTRNKVKITDRMWARLLSSTNQPSFLSQKDIDEAREADRLANKPPLPSGANQSVANAFGQSASSSSNGEI

SEQ ID NO: 6899 - protein, 554 aa, Hordeum vulgare
MASHIILPPDDEQQRREDEEQDGGAAGGGEQQQPPFSAMCVRISRDSYPNLRALRNASNVSLADAAHVKISEGDFGYVLDDVPHLADYLPDVPTYPNPLQDHPAYSTVKQYFVNEDDTVPQKVVVQKNSRRGVHFRRAGPRQRVNFESDEVKACIVTCGGLCPGLNTVIRELVCGLSHMYNVNKIYGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESPFYMDGEGGLLQYVERRLKENKHMVIVVAEGAGQDIIAKSIPASDQQDASGNKLLLDIGLWLTHKIKDHFKSKKMEMTIKYIDPTYMIRAIPSNAADNVYCTLLAHSAIHGAMAGYSSTVGMVNGRHAYIPFYRVTSTRNKVKITDRMWARLLSSTNQPSFLSQKDIDEAREADRLANKPPLPSVANHNVANAFDQSASASSNCEI

SEQ ID NO: 6900 - protein, 574 aa, Secale cereale
MASHIILPPDGDDDEQQRREDEENDGGSGSGSGGDGERQQQQQQQHPAQAKAALPFSAMCVRISRDSYPNLRALRNASNASLTDAAYVKISEGDFGYVLDDVPHLADYLPDVPTYPNPLQDHPAYSTVKQYFVNEDDTVPQKVVVQKNSRRGVHFRRAGPRQRVNFESDEVRACIVSCGGLCPGLNTVIRELVCGLAHMYNVNSIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESPFYMDGEGGLLQYVERRLKENKHMVIVVAEGAGQDIIAKSIPASDQQDASGNKLLLDIGLWLTHKIKDHFKSKKMEMTIKYIDPTYMIRAIPSNAADNVYCTLLAHSAIHGAMAGYSFTVGMVNGRHAYIPFYRVTSTRNKVKITDRMWARLLSSTNQPSFLSQKDIDEAREADRLANKPPLPSVANQSVAKAFDQSAAASSNGKI

SEQ ID NO: 6901 - protein, 378 aa, Secale cereale
ASHIILPPDGDDDEQQRREDEENDGGSGSGSGGDGERQQQQPHPAQAKAALPFSAMCVRISRDSYPNLRALRNASNASLTDAAYVKISEGDFGYVLDDVPHLADYLPDVPTYPNPLQDHPAYSTVKQYFVNEDDTVPQKVVVQKNSRRGVHFRRAGPRQRVNFESDEVKACIVSCGGLCPGLNTVIRELVCGLAHMYNVNSIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESPFYMDGKGGCFNM

SEQ ID NO: 6902 - protein, 556 aa, Secale cereale
QRREDEENDGGSGSGSGGDGERQQQQPHPAQAKAALPFSAMCVRISRDSYPNLRALRNASNASLTDAAYVKISEGDFGYVLDDVPHLADYLPDVPTYPNPLQDHPAYSTVKQYFVNEDDTVPQKVVVQKNSRRGVHFRRAGPRQRVNFESDEVKACIVSCGGLCPGLNTVIRELVCGLAHMYNVNSIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESPFYMDGEGGLLQYVERRLKENKHMVIVVAEGAGQDIIAKSIPASDQQDASGNKLLLDIGLWLTHKIKDHFKSKKMEMTIKYIDPTYMIRAIPSNAADNVYCTLLAHSAIHGAMAGYSFTVGMVNGRHAYIPFYRVTSTRNKVKITDRMWARLLSSTNQPSFLSQKDIDEAREADRLANKPPLPSVANQSVAKAFDQSAAASSNGEI

SEQ ID NO: 6903 - protein, 541 aa, Secale cereale
QAGAGATGAAAAVIRPRPSGACPSPPCSVPDLPRLLPLTSRALRNASNASLTDAAYVKISRATSDTSSTTCPTSPTTSPTSQLTRTRCKTPSIFNCQADLSMKMTRTTKGCVQKNSRRGVHFRRAGPRQRVNFESDEVRACIVSCGGLCPGLNTVIRELVCGLAHMYNVNSIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESPFYMDGEGGLLQYVERRLKENKHMVIVVAEGAGQDIIAKSIPASDQQDASGNKLLLDIGLWLTHKIKDHFKSKKMEMTIKYIDPTYMIRAIPSNAADNVYCTLLAHSAIHGAMAGYSFTVGMVNGRHAYIPFYRVTSTRNKVKITDRMWARLLSSTNQPSFLSQKDIDEAREADRLANKPPLPSVANQSVAKAFDQSAAASSNGEI

SEQ ID NO: 6904 - protein, 564 aa, Brachypodium distachyon
MASHIILPKEEEEEEGLGVAVEADHDSPEPPRYQAEPVPKALPFSATCVRISRDSYPNLRALRNASAVSLRDDDADFVKLEEGDYGYVLDDVQHLTDYLPELPTFPNPLQDHPAYSTVKQYFVNADDTVPEKVVVQKNSPRGVHFRRAGPRQRVYFEPEDVKACIVTCGGLCPGLNTVIRELVCGLSHMYNVNDVFGIQNGYKGFYSSNYLPMTPKSVNDIHKRGGTVLGTSRGGHDTRKIVDNIQDRGINQVYIIGGDGTQKGAYEIFKEIRRRGLKVAVAGIPKTIDNDIAVIDKSFGFDTAVEEAQRAIDAAHVEASSAENGIGLVKLMGRYSGFIAMCATLASRDVDCCLIPESPFYLEGEGGLFEYIERRLKENNHMVIVVAEGAGQDLIAKSIPAADQLDASGNKLLLDVGLWLTHKIKDYCKSKKMEMTIKYIDPTYMIRAIPSNASDNVYCTLLAHSAIHGAMAGYSSTVGMVHGRHAYIPFHRVTSTRNKVKITDRMWARLLSSTNQPSFLTQKDIDEAREADRLANRPPVPAGTSELREHTEKHPASESANGEK

SEQ ID NO: 6905 - protein, 566 aa, Secale cereale
MASHIILPKAEEEEEEVEEGLGVAVEADHDSPEPPRYRHTQPAQKALPFSATCVRISRDSYPNLRALRNASATSLRDDDAAFAKLDEGDYGYVLDDVQHLTDYLPELPIFPNPLQDHPAYSTVKQYFVNADDTVPEKVVVQKNSPRGVHFRRAGPRQRVYFEPEDVKACIVTCGGLCPGLNTVIRELVCGLSHMYNVNDVFGIQNGYKGFYSSNYLPMTPKSVNDVHKRGGTVLGSSRGGHDTHKIVDNIQDRGINQVYIIGGDGTQKGAYEIFKEIRRRGLKVAVAGIPKTIDNDIAVIDKSFGFDTAVEEAQRAIDAAHVEASSAENGIGLVKLMGRYSGFIAMYATLASRDVDCCLIPESPFYLEGEGGLFEYIERRLKENNHMVIVVAEGAGQDLIAKSIPVADQLDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVKITDRMWARLLSSTNQPSFLSKEDIMEAREAERLANRLPVPAGSSEHTKKHSASVLSNGEK

SEQ ID NO: 6906 - protein, 560 aa, Oryza sativa
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPTFPNPLQDHPAYSTVKQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEK

SEQ ID NO: 6907 - protein, 564 aa, Zea mays
MASSHIILPKEEEEEAAAAAVAEVGLGAAVEADHDHRPYQEQGPGKAALPFSATCVRISRDSYPNLRALRNASTMTLHDDDAAFVKLEEGDYGYVLDDVPHLTDYLPDLPTFPNPLQDHPAYSTVKQYFVNADDTVPEKVVVQKNSPRGVHFRRAGPRQRVYFESEEAKACIVTCGGLCPGLNTVIRELVCGLSHMYNVSNVFGIQNGYKGFYSSNYLPMTPKSVNDIHKRGGTVLGTSRGGHDTKKIVDNIQDRGINQVFIIGGDGTQKGAYEIYKEIRRRGLQVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHTVIVVAEGAGQDLIAQSIPAADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDIDAAREADKAANRMKSREDAKKQSTPVLANGEK

SEQ ID NO: 6908 - protein, 289 aa, Secale cereale
RRPRRRLPLLRPCACGSPADLLPPTSRALRNASHASLTDAAYVKISRATSDTSSTTSPTSQTTSPTSPTYPNPLKTTQHIQLSSSILSMKMTPYHKRLLFKDSRRGVHFRRAGPRQRVNFESDEVKACIVSCGGLCPGLNTVIRELVCGLAHMYNVNNIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGLIRPSKRLNVPLIQLMWKLAVLRME

SEQ ID NO: 6909 - protein, 565 aa, Panicum virgatum
MASSHIILPKEEEAEAEAEAETRLGTVVEADHDSPAQLPLQDHAPGKAALPFSATCVRISRDSYPNLRALRNASALNLHDDDAAFVKLEEGDYGYVLDDVPHLTDYIPDLPTYPNPLQDHPAYSTVKQYFVNADDTVPEKVVVQKNSPRGVHFRRAGPRQRVYFESEEVKACIVTCGGLCPGLNTVIRELVCGLSHMYNVNNVFGIQNGYKGFYSSNYLPMTPKSVNDIHKRGGTVLGTSRGGHDTKKIVDNIQDRGINQVYIIGGDGTQKGAYEIYKEIRRRGLQVAVAGIPKTIDNDIAVIDKSFGFDTAVEEAQRAINAAHVEASSAENGIGLVKLMGRYSGFIAMYATLASRDVDCCLIPESPFYLEGEGGLFEYVDRRLKENNHMVIVVAEGAGQDLIAQSIPIADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSKEDIDAAREADKAANNRKNGENAKKQHASVLAKGEK

SEQ ID NO: 6910 - protein, 566 aa, Hordeum vulgare
MASHIILPKEEEEEGLAVAVEADHDSPEPPRYRHLQPAQKALPFSATCVRISRDSYPNLRALRNASATSLRDDDAAFAKLDAGDYGYVLDDVQHLTDYLPELPTFPNPLQDHPAYSTVKQYFVNADDTVPEKVVVQKNSPRGVHFRRAGPRQRVYFEPEDVKACIVTCGGLCPGLNTVIRELVCGLSHMYNVNNVFGIQNGYKGFYSSNYLPMTPKSVNDIHKRGGTVLGSSRGGHDTHKIVDNIQDRGINQVYIIGGDGTQKGAYEIFKEIRRRGLKVAVAGIPKTIDNDIAVIDKSFGFDTAVEEAQRAIDAAHVEASSAENGIGLVKLMGRYSGFIAMYATLASRDVDCCLIPESPFYLEGKGGLFEYIERRLKENNHMVIVVAEGAGQDLIAKSIPVADQLDASGNKLLLDVGLWLTHKIKDYCKSKKMEMTIKYIDPTYMIRAIPSNASDNVYCTLLAHSAIHGAMAGYSFTVGMVHGRHAYIPFHRVTSTRNKVKITDRMWARLLSSTNQPSFLSEEDIIEAREAERLANRLSLSVPAGSSEHGEHAKKYSGSVLANGEK

SEQ ID NO: 6911 - protein, 562 aa, Panicum virgatum
MASSHIILPKEEEEAAAEAGLGVAVEADHDSPAQRPFQEQAPGKAALPFSATCVRISRDSYPNLRALRNASALDLHDDDAAFVKLEEGDYGYVLDDVPHLTDYLPDLPTFPNPLQDHPAYSTVKQYFVNADDTVPEKVVVQKNSPRGVHFRRAGPRQRVYFESEEVKACIVTCGGLCPGLNTVIRELVCGLSHMYNVSNVFGIQNGYKGFYSSNYLPMTPKSVNDIHKRGGTVLGTSRGGHDTKKIVDNIQDRGINQVYIIGGDGTQKGAYEIYKEIRRRGLQVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQNLIAQSIPAADQQDASGNKLLLDVGLWLTHKIKDYCKGKKMEMTIKYIDPTYMIRAIPSNASDNVYCTLLAHSAIHGAMAGYSFTVGMVNGRHAYIPFHRVTSTRNKVRITDRMWARLLSSTNQPSFLSKEDIDAAREADKAANKRMNGENAKKQPASVLANGEK

SEQ ID NO: 6912 - protein, 594 aa, Triticum aestivum
RRLATARQRSETPRFRFRFRFRFPRQPWRPTSSCRRTATTTSSSGGRTRRTTAAGAGATGQQQQAGGNDAKAALPFSAMCVRISRDSYPNLRALRNASHASLTDAAYVKISEGDFGYVLDDVPHLADYIPDVPTYPNPLQDHPAYSTVKQYFVDEDDTVPQKVVVQKNSRRGVHFRRAGPRQRVNFESDEVKACIVSCGGLCPGLNTVIRELVCGLAHMYNVNNIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESPFYMDGEGGLLQYVERRLKENKHMVIVVAEGAGQDIIAKSIPASDQLDASGNKLLLDIGLWLTHKIKDHFKSKKMEMTIKYIDPTYMIRAIPSNAADNVYCTLLAHSAIHGAMAGYSFTVGMVNGRHAYIPFYRVTSTRNKVKITDRMWARLLSSTNQPSFLRQKDIDEAREADRLTNKPPLPPVANQNVAKAFDQSASASSNGEI

SEQ ID NO: 6913 - protein, 503 aa, Secale cereale
RALRNASNASLTDAAYVKISEGDFGYVLDDVPHLADYLPDVPTYPNPLQDHPAYSTVKQYFVNEDDTVPQKVVVQKNSRRGVHFRRAGPRQRVNFESDEVKACIVSCGGLCPGLNTVIRELVCGLAHMYNVNSIFGIQNGYKGFYSSNYVAITPKTVNDIHKRGGTVLGTSRGGHDTKKIVDNIQDRGINQVYIIGGDGTQKGAYEIYKEIRKRGLKVAVAGVPKTIDNDIAIIDKSFGFDSAVEEAQRAINSAHVEACSAENGIGLVKLMGRYSGFIAMYATLASRDVDCCLIPESPFYMDGEGGLLQYVERRLKENKHMVIVVAEGAGQDIIAKSIPASDQQDASGNKLLLDIGLWLTHKIKDHFKSKKMEMTIKYIDPTYMIRAIPSNAADNVYCTLLAHSAIHGAMAGYSFTVGMVNGRHAYIPFYRVTSTRNKVKITDRMWARLLSSTNQPSFLSQKDIDEAREADRLANKPPLPSVANQSVAKAFDQSAAASSNGEI

SEQ ID NO: 6914 - protein, 483 aa, Sorghum bicolor
MALHDDDAAFVKIEEGDFGYVLDDVPHLTDYLPDLPTFPNPLQDHPAYSTVKQYFVNADDTVPEKVVVQKNSPRGVHFRRAGPRQRVYFESEEVKACIVTCGGLCPGLNTVIRELVCGLSHMYNVSNVFGIQNGYKGFYSSNYLPMTPKSVNDIHKRGGTVLGTSRGGHDTKKIVDNIQDRGINQVYIIGGDGTQKGAYEIYKEIRRRGLHVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQDLIAQSIPAADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDIDAAREADKAANAKNQSAPALANGEK

SEQ ID NO: 6915 - protein, 563 aa, Pennisetum glaucum
MASSHIILPKEEEEAAAAEAGLGVAVEADHDSPAQRPYQEPAPGKAALPFSATCVRISRDSYPNLRALRNASALDLHDDDAAFVKVEEGDYGYVLDDVPHLTDYLPDLPTFPNPLQDHPAYSTVKQYFVNADDTVPEKVVVHKNSSRGVHFRRAGPRQRVYFESEEVKACIVTCGGLCPGLNTVIRELVCGLSHMYNVNDVFGIQNGYKGFYSSNYLPMIPKSVNDIHKRGGTVLGTSRGGHDTKKIVDNIQDRGINQVYIIGGDGTQKGAYEIYKEIRRRGLQVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQDLIAQSIPAADQQDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDVDAAREADKAANSRRNGENVKKQPALLLANGEK

SEQ ID NO: 6916 - protein, 1044 aa, Saccharum officinarum
MARRDHDDDDEIEEEEDEEEAYDLDEEEEEDEEDDYEEEARRGKASRGGGSGGGRKRSREDNFIDDLAIEDDDEEDDDDDGGGRPRKKGGGGVRGFFDEEAQVDEDEEEEDEGEGEDDFINDAGADLPDEDVVRGSRRHSIPMRDEEEDIDEIERQVRERYARSTHIEYGEEAAEVEQQALLPSVKDPKLWMVKCAIGHERETAICLMQKYIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEGREAVKKKAFVPPPRFFNIDEAREMHIRVERRRDKESGEYFEWVDNLKFKDGFLYKSVSTKSIHTNNIQPTFDELEKFKKPGEDMNGDMASLSTLFANRKKGHFMKGDAVIVVKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIDRRSSAKDRSNNIISAKDVVRVIEGACKGKQGPVEHIHKGILFIYDRHHLEHAGFICAKAQSCLLVGGSTGGRRGNGMDTADARLGALRSSASILQSPGRLPPRGPNMNYGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPMRDPGATPIHDGMRTPMRSRAWAPMSPPRDNWEDGNPATWGSSPAYQPGTPQARPYEAPTPGSGWANTPGVSFNDAPTPRDNYANAPSPYVPSTPVGQPMTPNSAAYLPGTPGGQPMTPGNVGMDIMSPIIGGEGDGTWLLPDVLVNVLRGGDDGPGVVREVLGDGSCRVALGSSGNGDMVTVLPNEVEVIRPKKSDRIKILNGNFRGYTGKLIGIDGSDGIVRLDDTYEVKILDMVILAKLAT

SEQ ID NO: 6917 - protein, 1049 aa, Panicum virgatum
MARRGRDDDDDEVEEDEDEEEAYDLDDEEEDEEDDYEEEARRGKASRGGGGGGKGGGGGGRKRSREDNFIDDSAIEDDEEDEDDDGGARPRKKGGGGVRGFFDEEAQVDEDEEEEDDGEGEDDFINDAGADIPDEDVVRGSRRHSMPMRDEEEDIDEIERQVRERYARSTHIEYGEEAAEVEQQALLPSVKDPKLWMVKCAIGHERETAICLMQKYIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEGRDTVKKKAFVPPPRFFNIDEAREMHIRVERRRDKESGEYFEWVDNLKFKDGFLYKSVSTKSIHTNNIQPSFDELEKFRKPGDDMNGDMASLSTLFANRKKGHFMKGDAVIVIKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIDRRASVKDRSNNIISAKDVVRVVEGACKGKQGPVEHIHKGILFIYDRHHLEHAGFICAKAQSCLLVGGSTGGRRGNGMDTADARLGALRSPASILQSPGRLPPRGPHMNYGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPIRDPGATPIHDGMRTPMRSRAWAPMSPPRDNWEDGNPATWSSSPAYQPGTPPARPYEAPTPGSGWANTPGVSFNDAPTPRDNYANAPSPYVPSTPVGQPMTPNSAAYLPGTPGGQPMTPGNVGMDIMSPIIGGEGEGTWLLPDVLVNVLRGGDDGPGVVREVLGDGSCRVALGSSGNGDMVTVLPNEVEVIRPKKSDRIKILNGNFRGYTGKLIGIDGSDGIVKLDDTYEVKILDMVILAKLAT

SEQ ID NO: 6918 - protein, 1049 aa, Panicum virgatum
MARRGRDDDDDDEAEEEEDEEEAYDLDDEEEDEEDDYEEEARRGKASRGGGGGGKGGGGRKRSREDNFIDDSAIEDEDEEEEDDDGGARPRKKGGGGVRGFFDEEAQVDEDEEEEDDGEGEDDFINDAGANIPDEDVVRGSRRHSMPMRDEEEDIDEIERQVRERYARSTHIEYGEEAAEVEQQALLPSVKDPKLWMVKCAIGHERETAICLMQKYIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEGRETVKKKAFVPPPRFFNIDEAREMHIRVERRRDKESGEYFEWVDNLKFKDGFLYKSVSTKSIHTNNIQPSFDELEKFRKPGDDMNGDMASLSTLFANRKKGHFMKGDAVIVIKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIDRRASAKDRSNNIISAKDVVRVVEGACKGKQGPVEHIHKGILFIYDRHHLEHAGFICAKAQSCLLVGGSTGGHRGNGMDTADARLGALRSPASILQSPGRLPPRGPHMNYGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPIRDPGATPIHDGMRTPMRSRAWAPMSPPRDNWEDGNPATWSSSPAYQPGTPPARPYEAPTPGSGWANTPGVSFNDAPTPRDNYANAPSPYVPSTPVGQPMTPNSAAYLPGTPGGQPMTPGNVGMDIMSPIIGGEGEGTWLLPDVLVNVLRGGDDGPGVVREVLGDGSCRVALGSSGNGDVVTVLPNEVEVIRPKKSDRIKILNGNFRGYTGKLIGIDGSDGIVKLDDTYEVKILDMVILAKLAT

SEQ ID NO: 6919 - protein, 1048 aa, Setaria italica
MARRGRDDDDDEVEEEEDEEEAYDLDDEEEDEEEDYEEEARRGKASRGGGGGKAGGGGRKRSREDNFIDDSAIEDEDEDDEDDDGGARPRKKGGGGVRGFFDEEAQVDEDEEEEEEGEGEDDFINDAGADIPDEDVVRVARRHSMPMRDEDEDIDEIERQVRERYARSTHIEYGEEAAEVEQQALLPSVKDPKLWMVKCAIGHERETAICLMQKYIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRVDLQALASKLEGREAVKKKAFVPPPRFFNIDEAREMHIRVERRRDKESGEYFEWVDNLKFKDGFLYKSVSTKSIHTNNIQPTFDELEKFRKPGDDMNGDVASLSTLFANRKKGHFMKGDAVIVIKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIDRRASAKDRSNNIISAKDVVRVVEGACKGKQGPVEHIHKGILFIYDRHHLEHAGFICAKAQSCLLVGGSTGGRRGNGMDTADARLGALRSPASILQSPGRLPPRGPHMNFGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPMRDPGATPIHDGMRTPMRSRAWAPMSPPRDNWEDGNPATWGSSPAYQPGTPPARPYEAPTPGSGWANTPGVSFNDAPTPRENYANAPSPYVPSTPVGQPMTPNSAAYLPGTPGGQPMTPGNVGMDIMSPIIGGEGEGTWLLPDVLVNVLRGGDDGPGVVREVLGDGSCRVALGSSGNGDMVTVLPNELEVIRPKKSDRIKILNGNFRGYTGKLIGIDGSDGIVKLDDTYEVKILDMVILAKLAT

SEQ ID NO: 6920 - protein, 1045 aa, Zea mays
MARRGHDDDDDEVDEEEEEDAYDLDDDEDEDEEDDYEEETRRGKASRGGGGAKSGGGRKRSREDNFIDDSAIEDEDDEDDDGGGRPRKKGGGGVRGFFDEEAQVDEDEEEEDEGEGEDDFINDAGADLPDEDVVRGSRRHSIPMRDEEEDIDEMERQVRERYARSTHIEYGEEAAEVEQQALLPSVKDPKLWMVKCAIGHERETAICLMQKFIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEGRDIVKKKAFVPPPRFFNIDEAREMHIRVERRRDKESGEYFEWVDNLKFKDGFLYKSVSTKSIHKSNIQPTFDELEKFKKPGDDMNGDMASLSTLFANRKKGHFMKGDAVIVIKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIERRSSAKDRSNNIISAKDVVRVVEGACKGKQGPVEHIHKGMLFIYDRHHLEHAGFICAKAQSCLLVGGSTGGRRGNGMDTADARLDALRSSASILQSPGRLPPRGPNMNYGGRFGGGRGGRGYDALVGKCIKIKSGPYKGYRGRVKEVTGALVRVELDSLMKIVTVKRDDIADTPTVATPFREPRYSLGGETPMHPSRTPHHAYQTPMRDPGATPIHDGMRTPMRSRAWAPMSPPRDNWEDGNPATWGSSPAYQPGTPQARPYEAPTPGSGWANTPGVSFNDAPTPRDNYANAPSPYVPSTPVGQPMTPNSASYLPGTPGGQPMTPGNAGMDMLSPIIGGDGEVAWLLPDVLVNVLRGGDDGPGVVREVLGDGSCRVALGSSGNGDVVTVLANEVEVIRPKKSDRIKILNGNFRGYTGKLIGIDGSDGIVRLDETYEVKILDMVILAKLAT

SEQ ID NO: 6921 - protein, 1017 aa, Panicum virgatum
EEDDYEEEARRGKASRGGGGKGGGGGGRKRSREDNFIDDSAIEDDDEEEEDDDGGARPRKKGGGGVRGFFDEEAQVDEDEEEEDDGEGEDDFINDAGANIPDEDVVRGSRRHSMPMRDEEEDIDEIERQVRERYARSTHIEYGEEAAEVEQQALLPSVKDPKLWMVKCAIGHERETAICLMQKYIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEGRDTVKKKAFVPPPRFFNIDEAREMHIRVERRRDKESGEYFEWVDNLKFKDGFLYKSVSTKSIHTNNIQPSFDELEKFRKPGDDMNGDMASLSTLFANRKKGHFMKGDAVIVIKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIVRVEAEAFQVLKGVPDRPEVVLVKLREIKSKIDRRASAKDRSNNIISAKDVVRVVEGACKGKQGPVEHIHKGILFIYDRHHLEHAGFICAKAQSCLLVGGSTGGRRGNGMDTADARLGALRSPASILQSPGRLPPRGPHMNYGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPIRDPGATPIHDGMRTPMRSRAWAPMSPPRDNWEDGNPATWSSSPAYQPGTPPARPYEAPTPGSGWANTPGVSFNDAPTPRDNYANAPSPYVPSTPVGQPMTPNSAAYLPGTPGGQPMTPGNVGMDIMSPIIGGEGEGTWLLPDVLVNVLRGGDDGPGVVREVLGDGSCRVALGSSGNGDMVTVLPNEVEVIRPKKSDRIKILNGNFRGYTGKLIGIDGSDGIVKLDDTYEVKILDMVILAKLAT

SEQ ID NO: 6922 - protein, 1007 aa, Pennisetum glaucum
RRGKASRGGGGGKAGGGRKRSREDNFIDDSAIEDEDEEDEDDDGGARPRKKGGGGVRGFFDEEAQVDEDEEEEDDGEGEDDFINDAGADIPDEDVVRGSRRHSIPMRDEEEDIDEIERQVRERYARSTHIEYGEEAAEVEQQALLPSVKDPKLWMVKCAIGHERETAICLMQKYIDRSDLQIKSVVALDHLKNYIYVEAEKEAHVKEACKGLRNIYASAKITLVPIKEMADVLSVESKSVDLSRDSWVRMKLGIYKGDLAKVVDVDNVRQRVDVKLIPRIDLQALASKLEGREAVKKKAFVPAPRFFNIDEAREMHIRVERRRDKESGEYFEWVDNLKFKDGFLYKSVSTKSIHTNNIQPTFDELEKFKKPGDDMNGDMASLSTLFANRKKGHFMKGDAVIVIKGDLKNLEGWVEKVEDETVHIRPKISDLPKTLAFNEKELCKYFKPGDHVKVISGVQEGATGMVVKVEGHVLIILSDTTKEHIRVFADHVVESSEITTGITRIGDYELHDLVLLDNLSFGVIIRVEAEAFQVLKGVPDRPEVVLVKLREIKSKIDRRASAKDRSNNIISAKDVVRVVEGACKGKQGPVEHIHKGILFIYDRHHLEHAGFICAKAQSCLLVGGSTGGRRGNGMDTADARLGALRSPASILQSPGRLPPRGPHMNFGGRFGGGRGGRGHDALVGKCIKIKSGPYKGYRGRVKEVTGALVRVELDSLMKIVTVKRDDIADTPTVATPFREPRYSLGGETPMHPSRTPHHAYQTPMRDPGATPIHDGMRTPMRSRAWAPMSPPRDNWEDGNPATWGSSPAYQPGTPPARPYEAPTPGSGWANTPGVSFNDAPTPRENYANAPSPYVPSTPVGQPMTPNSAAYLPGTPGGQPMTPGNVGMDIMSPIIGGEGEGTWLLPDVLVNVLRGGDDGPGVVREVLGDGSCRVALGSSGSGDMVTVLPNELEVIRPKKSDRIKILNGNFRGYTGKLIGIDGSDGIVKLDDTLEVKILDMVILAKLAS

SEQ ID NO: 6923 - protein, 1056 aa, Oryza sativa
MARRARDDDDDDEVEEEDEEEAYDLEDEEEEEDDEDDYEAEARGGGKASRSSSSRGGGGGGGGGRKRSREDNFIDDSAIEDDEEDDDDDDGGGRPKKKGGGGGVRGFFDEEAQVDEDEEEEDDGEGEDDFINDAGADLPDEDVVRGSRHRSIPMRDEEEDIDEIERQVRERYARSTHIEYGEEAAEVEQQALLPSVKDPKLWMVKCAIGHERETAICLMQKFIDRSDLQIKSVVALDHLKNYIYVEAEKEAHVKEACKGLRNIYASAKITLVPIKEMADVLSVESKSVDLSRDAWVRMKLGIYKGDLAKVVDVDNVRQRVTVKLIPRIDLQALASKLEGREAVKKKAFVPPPRFFNIDEAREMHIRVERRRDKDSGEYFEMIDGLMFKDGFLYKTVSIKSISTQNIQPSFDELEKFRKPGDDMNGDMSSLSTLFANRKKGHFMKGDAVIVIKGDLKNLEGWVEKVEDETVHIRPKISDLPKTLAFNEKELCKYFKPGDHVKVVSGVQEGATGMVVKVEGHVLIILSDTTKEHIRVFADHVVESSEITTGITRIGDYELHDLVLLDNLSFGVIIRVETEAFQVLKGVPDRPEVVLVKLREIKSKIDRRTSAKDRSNNMISSKDVVRVVEGACKGKQGPVEHIHKGILFIYDRHHLEHAGFICAKAQSCLLVGGSAGGRRGNGMDTSDPRLGALRSPASILQSPGRLPPRGPHMNFGGRFGGGGRGGRGHDALVGKCIKIKSGPYKGYRGRVKEVTGVLVRVELDSLMKIVTVKRDDIADTPTVATPFREPRYPLGGETPMHPSRTPLHPYQTPMRDPGATPIHDGMRTPMRRGWAPMSPPRDNWEEGNPATWGSSPAYQPGTPPARPYEAPTPGSGWANTPGVSYNDAPTPRESNYGNAPSPYVPSTPVGQPMTPNSASYLPGTPGGQPMTPGNVGMDIMSPIIGGEGEGNWLLPDVLVNVLRAGDDGPGVVREVLADGSCRVALGSSGNGEIVTVLPTELEVIRPKKSDKIKIMNGNFRGYSGKLIGIDGSDGIVKLDDTYEVKILDMVILAKLAS

SEQ ID NO: 6924 - protein, 1053 aa, Brachypodium distachyon
MARRGRDEDDDEVEEEEDEEEAYDLDEEEDEEDDYEEEARGRGKAAARSRGSGGGGGSGGRKRSRQDNFIDDSAIEDDDEEDEDDDGGGRPRKKGGGGVRGFFDEEAQVDEDEEEEDEGEGEDDFINDAGADIPDDDAARGSRSRHSIPMRDEEEDIEEIERQVRERYARSTHIEYGEEAADVEQQALLPSVKDPKLWMVKCAIGHERETAICLMQKFIDRTDLQIKSVVALDHLKNYIYVEAEKEAHVKEACKGLRNIYASAKITLVPIKEMADVLFVESKTVDLSRDTWVRMKLGVYKGDLAKVVDVDTVRQRVTVKLIPRMDLQALASKLEGREVVKKKTFVPPPRFFNIDEARELHIRVERKRDKDSGEYFEMVDGLMFKDGFLHKTVSTKSIHTQGIQPTFDELEKFRKPGDDMNGDMASLSTLFSNRKKGHFMKGDAVIVIKGDLKNLEGWVEKVEDTTVHIRPKLSDLPKTLAFNEKELCKYFKPGDHVKVVSGVQEGATGMVVKVDGHVLIILSDTTKEHIRVFADHVVESSEITTGITRIGDYELHDLVLLDNLSFGVIIRVETEAFQVLKGMPDRPEVVMVKLREIKSKIDRRASAQDKSNNMISTKDVVRVVEGPCKGRQGPVEHIHKGILFIYDRHHLEHAGFICAKAKQCLLIGGSNGGRRGNGMDAADARLGALRTPASILQSPGKLPPRGPYMNSGGRFGGGGRGGRGYDALVGKCIKIKSGPYKGYRGRVKEVTGVLVRVELDSLMKIVTVKREDIADTPTVATPFREPRYSMGGETPMHPSRTPLHPFQTPMRDPGATPIHDGMRTPMRSRAWAPMSPPRDNWEDGNPDTWGSSPAYHPGTPPARPYEAPTPGSGWANTPGVSYNDVPTPRESNYGNAPSPYVPSTPVGQPMTPNSASYLPGTPGGQPMTPGNVGMDMMSPIIGGEGEVNWLLPDVLVNVLRAGDDGPGIVREVLGDGSCRVALGSSGNGDIVTVLPNELEAVRPKKGDRIKILNGNFRGFVGKLIGIDGSDGIVKLDDTYEVKILDMVILAKLAT

SEQ ID NO: 6925 - protein, 1051 aa, Secale cereale
MARRGRDDDDDEVEEEEEDEEEAYDLDDEEEDEGDDYEEEARGRGKAASRSRAPAGGVRKRSRQDNFIDDSAIEDDDEDEEDDGGSRPRKKGGGGGVRGFFDEEAQVDEDEEEEDEGEGEDDFINDAGADIPDDDAGRGSRSRHSIPMRDEEEDIDEIERQVRERYARSTHIEYGEEAADVEQQALLPSVKDPKLWMVKCAIGHERETAICLMQKFIDRTDLQIKSVVALDHLKNYIYVEAEKEAHVKEACKGLRNIYSSAKITLVPIKEMADVLYVESKNVDLARDTWVRMKLGVYKGDLAKVVDVDNVRQRVTVKLIPRIDLQVLASKLEGRVVAKKKTFLPPPRFFNIDEAREMHIRVERRRDKDSGEYFEMVDGLMFKDGFLYKPVSIKSIHTQGIQPSFDELEKFKKPGDDMNGDMSSLNTLFSNRKKGHFMKGDAVIVVKGDLKNLEGWVEKVEDTTVHIRPKISDLPKTLAFNEKELCKYFKPGDHVKVVSGVQEGTTGMVVKVDGHVLIILSDTTKEHIRVFADHVVESSEITTGITRIGDYELHDLVLLDNLSFGVIIRVETEAFQVLKGVPDRPEVVLVKLREIKSKIDRRTSAKDRFNNMVATKDVVRVVDGACKGTQGPVEHIHKGILFIYDRHHLEHAGFICAKAQACILVGGSTGGRRGNGMDPADARLGALRSPASILQSPGRLPPRGPQMNYGGRFGGGGRGGRGHDALVGKCIKIKSGPYKGYRGRVKEVTGVLVRVELDSLMKIVTVKRDDIADTPTVATPFREPRFSLGSETPMHPSRTPLHPFQTPMRDPGATPIHDGMRTPMRSRAWAPMSPPRDNWEDGNPDTWGSSPAYQPGTPPARPYEAPTPGSGWANTPGVSYNDVPTPRESNYANAPSPYVPSTPVGQPMTPNSAAYLPGTPGGQPMTPGNAGMDIMSPVMGGEGEGNWALPDVLVNVLAAGDEGPGVVREVLGDGTCRVALGSSGNGDIVTVLPTELEVIRPKKSDRIKIMNGTFRGFVGKLIGIDGSDGIVKLDDTYEVKILDMVILAKLAA

SEQ ID NO: 6926 - protein, 1017 aa, Triticum aestivum
DDYEEEARGRGKAASRSRAPAGGVRKRSRQDNFIDDSAIEDDDEDEEDDGGSRPRKKGGGGGVRGFFDEEAQVDEDEEEEDEGEGEDDFINDAGADIPDDDAGRGSRSRHSIPMRDEEEDIDEIERQVRERYARSTHIEYGEEAADVEQQALLPSVKDPKLWMVKCAIGHERETAICLMQKFIDRTDLQIKSVVALDHLKNYIYVEAEKEAHVKEACKGLRNIYSSAKITLVPIKEMADVLYVESKNVDLARDTWVRMKLGVYKGDLAKVVDVDNVRQRVTVKLIPRIDLQVLASKLEGRVVAKKKTFVPPPRFFNIDEAREMHIRVERRRDKDSGEYFEMVDGLMFKDGFLYKPVSIKSIHTQGIQPSFDELEKFKKPGDDMNGDMSSLNTLFSNRKKGHFMKGDAVIVVKGDLKNLEGWVEKVEDTTVHIRPKISDLPKTLAFNEKELCKYFKPGDHVKVVSGVQEGTTGMVVKVDGHVLIILSDTTKEHIRVFADHVVESSEITTGITRIGDYELHDLVLLDNLSFGVIIRVETEAFQVLKGVPDRPEVVLVKLREIKSKIDRRTSAKDRFNNMVATKDVVRVVDGACKGTQGPVEHIHKGILFIYDRHHLEHAGFICAKAQSCILVGGSTGGRRGNGMDAADARLGALRSPASILQSPGRLPPRGPQMNYGGRFGGGGRGGRGHDALVGKCIKIKSGPYKGYRGRVKEVTGVLVRVELDSLMKIVTVKRDDIADTPTVATPFREPRFSLGSETPMHPSRTPLHPFQTPMRDPGATPIHDGMRTPMRSRAWAPMSPPRDNWEDGNPDTWGSSPAYQPGTPPARPYEAPTPGSGWANTPGVSYNDVPTPRESNYANAPSPYVPSTPVGQPMTPNSAAYLPGTPGGQPMTPGNAGMDIMSPVMGGEGEGNWALPDVLVNVLAAGDEGPGVVREVLGDGTCRVALGSSGNGDIVTVLPTELEVIRPKKSDRIKIMNGTFRGFVGKLIGIDGSDGIVKLDDTYEVKILDMVILAKLAA

SEQ ID NO: 6927 - protein, 1068 aa, Secale cereale
SSRRPSRAPENLAAKSTHGSPRPRRRRRRGRGGGGGRGGGLRPRRRGGGRGGRLRGGGEGPGQGGLPLPRPAGGVRKRSRQDNFIDDSAIEDDDEDEEDDGGSRPRKKGGGGGVRGFFDEEAQVDEDEEEEDEGEGEDDFINDAGADIPDDDAGRGSRSRHSIPMRDEEEDIDEIERQVRERYARSTHIEYGEEAADVEQQALLPSVKDPKLWMVKCAIGHERETAICLMQKFIDRTDLQIKSVVALDHLKNYIYVEAEKEAHVKEACKGLRNIYSSAKITLVPIKEMADVLYVESKNVDLARDTWVRMKLGVYKGDLAKVVDVDNVRQRVTVKLIPRIDLQVLASKLEGRVVAKKKTFLPPPRFFNIDEAREMHIRVERRRDKDSGEYFEMVDGLMFKDGFLYKPVSIKSIHTQGIQPSFDELEKFKKPGDDMNGDMSSLNTLFSNRKKGHFMKGDAVIVVKGDLKNLEGWVEKVEDTTVHIRPKISDLPKTLAFNEKELCKYFKPGDHVKVVSGVQEGTTGMVVKVDGHVLIILSDTTKEHIRVFADHVVESSEITTGITRIGDYELHDLVLLDNLSFGVIIRVETEAFQVLKGVPDRPEVVLVKLREIKSKIDRRTSAKDRFNNMVATKDVVRVVDGACKGTQGPVEHIHKGILFIYDRHHLEHAGFICAKAQACILVGGSTGGRRGNGMDPADARLGALRSPASILQSPGRLPPRGPQMNYGGRFGGGGRGGRGHDALVGKCIKIKSGPYKGYRGRVKEVTGVLVRVELDSLMKIVTVKRDDIADTPTVATPFREPRFSLGSETPMHPSRTPLHPFQTPMRDPGATPIHDGMRTPMRSRAWAPMSPPRDNWEDGNPDTWGSSPAYQPGTPPARPYEAPTPGSGWANTPGVSYNDVPTPRESNYANAPSPYVPSTPVGQPMTPNSAAYLPGTPGGQPMTPGNAGMDIMSPVMGGEGEGNWALPDVLVNVLAAGDEGPGVVREVLGDGTCRVALGSSGNGDIVTVLPTELEVIRPKKSDRIKIMNGTFRGFVGKLIGIDGSDGIVKLDDTYEVKILDMVILAKLAA

SEQ ID NO: 6928 - protein, 941 aa, Triticum aestivum
EEEEDEGEGEDDFINDAGADIPDDDAGRGSRSRHSIPMRDEEEDIDEIERQVRERYARSTHIEYGEEAADVEQQALLPSVKDPKLWMVKCAIGHERETAICLMQKFIDRTDLQIKSVVALDHLKNYIYVEAEKEAHVKEACKGLRNIYASAKITLVPIKEMADVLYVESKNVDLARDTWVRMKLGVYKGDLAKVVDVDNVRQRVTVKLIPRIDLQVLASKLEGRVVAKKKTFVPPPRFFNIDEAREMHIRVERRRDKDSGEYFEMVDGLMFKDGFLYKPVSIKSIHTQGIQPSFDELEKFKKPGDDMNGDMSSLNTLFSNRKKGHFMKGDAVIVVKGDLKNLEGWVEKVEDTTVHIRPKISDLPKTLAFNEKELCKYFKPGDHVKVVSGVQEGTTGMVVKVDGHVLIILSDTTKEHIRVFADHVVESSEITTGITRIGDYELHDLVLLDNLSFGVIIRVETEAFQVLKGVPDRPEVVLVKLREIKSKIDRRTSAKDKFNNMVATKDVVRVVEGACKGTQGPVEHIHKGILFIYDRHHLEHAGFICAKAQSCILVGGSTGGRRGNGMDAADARMGALRSPASILQSPGRLPPRGPQMNYGGRFGGGGRGGRGHDALVGKCIKIKSGPYKGYRGRVKEVTGVLVRVELDSLMKIVTVKRDDIADTPTVATPFREPRFSLGSETPMHPSRTPLHPFQTPMRDPGATPIHDGMRTPMRSRAWAPMSPPRDNWEDGNPDTWGSSPAYQPGTPPARPYEAPTPGSGWANTPGVSYNDVPTPREGNYANAPSPYVPSTPVGQPMTPNSAAYLPGTPGGQPMTPGNAGMDIMSPVIGGEGEVNWALPDVLVNVLAAGDEGPGVVREVLGDGTCRVALGSSGNGDIVTVLPSELEVIRPKKSDRIKIMNGTFRGFVGKLIGIDGSDGIVKLDDTYEVKILDMVILAKLAA

SEQ ID NO: 6929 - protein, 949 aa, Setaria italica
MADALFVVLRKVALSLGERTLERIGAEVVEAAPVLTDFEHSLKQIEDELLILQAFVGQVGPHKVGDKAFDAWLDQVRDVAHEVEDIIDEHAYLAAQAVDTGSFFKRKFRQIKNFVAWQKFTSQISQVEARIQRLGEMRNRYGISVGEIHRSNKLRHPNQLFMSESSYLTDNSEIVGHADEIERLTQWLLEEKQERTLIAIFGMGGLGKSTIASSAYKNQKISRTFDCHAWVTVSQTYQVEELLREIINQLIDQRASVAGGFMTMSRLRLVEVIQSYLRDKKYFIVLDDVWDRDAWLFLNYAFVRNNSGSKVLITTRRMDVSSLAVDKYVIELKTLPYAESWELFCKRAFYASKDNICPENLRSLAEKIVAKCQGLPLAIVTIGSTLSYREFEEQEWAFFYNQLSWQLANNPELSWISNVLNMSLNDLPSYLRICFLYCSLYPEDYRIRRKLISKLWIAEGLVEDREDGTTMEEVAKYYLTELTQRCLLRVTECNACGRPRTFVMHDLVREVTSVIAKKEKFGIAYRDAGITKVSHEARRLSIQKGAQSLNSLTSSRLRSFILFDPEVPSSWIYDVLSQFRLLRVLCLRFANIEQVPGMVTELYNLRYLDFSHTKVKHIPVSFKKLRNLQVLDLRFSYVEELPLEITTLINLRHLYVIVIHDLQQRSLDCFSAVKILGNICHLKNLQTLHIVSANKDLVSQLGNLTLMRSLAIMKVRQSCIAELWSSLTKMPNLSRLLISACDMDEVLDLRMLKPLPNLKFLWLSGKLAEGVLPLIFSKFEKLALLKMDWSGLKKDPIISFSHMLNLVDLRLYGTYGGEQLTFCAEWFPKLNSLQLADMEHLNWIDIEDGTMIGLYHLELIGLRNLKAVPVGIKYIRKLHQMFLTDMPNEFIQRLQGSDDDIVQHIPNVHIFDSSDSKAVNTFHFVPYLAKKYGPGATKYAPTYWGSSSI

SEQ ID NO: 6930 - protein, 949 aa, Zea mays
MADALFVVLSKLADSLGEQTLERISTKLIEVAPVLTDFEHSMKQIEAELLILQAFIAQVGTKVGDKAFDAWLDQVRDVAHEVEDIIDEYAYLEVQAVDTGSFFKRKFLQIKKFAAWQKFHSQISHVEARIQRLGEIRNRYGILSGEIDRSKKLRSPNRLFMSDSSYLTDNSEIVGHVDEIGRLTQWLLEYKQERTLIAVFGMGGSGKTTIASSAYKSQKITRTFNCHAWVTVSQTYQVEELLREIINQLIDQRASMSSGFMTMSGLRLVEVIQSYLQDKKYFIVLDDVWDKDAWLFLNYAFVRNNCGSKVLITTRRKDVSSLAVDQYTIELKTLQYAESWELFCKKAFRASKDNQCPENLRFCAEKIVARCQGLPLAIVTIGSVLSYHEFEEQGWESFYSQLSWQLANNPELNWISNVLNMSLNDLPSYLRNCFLYCSLYPEDYKIKRKVISKLWIAEGLVEDREDGTTMEEVANYYLVELTQRCLLRVTESNACGRPRAFVMHDLVRELTSNIAKKEKFGIAYGDASTTQVPPEVRRLSVKTATAADHMTYSITRLRSFILFDTEVPCSWIDDVLSRFRLLRVLCLRFANIAEVPGVVTELYNLRYIDFSYTKVKTIPASFRKLVNLQVLDLRFTYVEELPLEITTLTNLRHLHVFAVHDFQQRSLNCLGATKIPVNICHLKNLQAIQIVLANKDLVSQLGNLKLMRSLAIAEVRQSYIAELWKSLTKMPNLNRLAISTCNMEEILDFKMLKPLSNLVFFKLAGKLESGVLPLMLYYFEKLTWLQLDWSGLKKDPMSSLSHMSNLVHLFMCGSYCGEQLTFCSGWFPKLNYLQLSKMENLNWIEIEDGTMMCLNNLYLVDLGNLKAVPYGIKYIRTLHQMHLTDMSKEFLGSLQGSASPVVQHICNIHIFESSDSEAVNKFFFEPYLATKFGPGATKHAPTYLGSSGI

SEQ ID NO: 6931 - protein, 106 aa, Vigna unguiculata
MDMSNPAAFVNAELLHFYVGRRVRTLMQVVRSDGGVVIGKSTDEKQLVVKGLPPAPLTTFVEVFGIVNSDKSIAAEIWTNFGDSIDMISYNKLCQLANGELKYLFL

SEQ ID NO: 6932 - protein, 97 aa, Glycine max
MDISNPAALVNAELLHFYVGSRVRVVMQVVRSDGVVIGKSTDEKQLVVKGSPPPAPHTTYVEVYGAEIWTNFGDAIDMDSYNKLCQLANGEFKHLFL

SEQ ID NO: 6933 - protein, 106 aa, Phaseolus vulgaris
MDMSNPAAFVNAELLHFYVGRRVRALMQVVRSDGGVVIGKSTDEKQVVVKGTPPAPLTTFVEVFGIVSSDKSIAAEIWTNFGDSIDMFSYNKLCQLANGELRHLFL

SEQ ID NO: 6934 - protein, 107 aa, Lotus japonicus
MDTSNPAVFVNAELLQFHVGRRVRAVMQVVRSDGAVVIGKSTDDKQLVVKGSPPPAPLTTFVEVIGIVDSDKSIRAEMWTNFGDSIDMVSYQKLCQLANGEFKHLFL

SEQ ID NO: 6935 - protein, 107 aa, Cajanus cajan
MDTSNPAAFVNAELLHFYVGRRVRALMQVIRSDGGIVIGKSTDEKQLVVKGSPPPAPLTTFVEVFGIVNNDKSISPEIWTNFGDAVDMFTYNKLCQLAYGEYKHLFL

SEQ ID NO: 6936 - protein, 107 aa, Cicer arietinum
MDASKTAVFVNAELLPFYVGRRVRTVMQVVRSDGVAVIGKSPDEKQMVVKGSAPPAPLTSFVEVIGIVNSDKSIRAETWTNFGDAIDMFSYCKLCQLANGEFKHLFL

SEQ ID NO: 6937 - protein, 139 aa, Arachis hypogaea
GMNPRSLFYSSSSSSHFCVPLCFAATKPFTQEYGHIKSCSFCQCRTLAVLCWKEGSGCDAGCAIRGGLVIGKSTDEKQLVVKGPPPPAPLTNFVEVIGIVDNDRSIRAEIWTNFGNVIDMFSYNKLCQLANGEFKHLFV

SEQ ID NO: 6938 - protein, 135 aa, Glycine max
MDLLELWAIFGPGVAGAVFGAGWWIWLDAVVCSTVTVPFLHYLPGIFASLAALMFNCVRKEDIDYSPYDEGEWRLKLWLFIAYVVSFVSLAGSAGLLIQDSLDKSAPSVWTGVAGVLQCVFVLICGLVYWTSHPE

SEQ ID NO: 6939 - protein, 135 aa, Cajanus cajan
MDLMELWAIFGPGVAGAVFGAGWWIWLDAVVCSSVTVPFLHYLPGIFASFAALMFNCVRKEDIDYSPYDEGEWRLKLWLFIAYVVSFVSLAGSAGLLIQDSLDKSAPSVWAGVAGVLQCVFVLISGLIYWTSHPE

SEQ ID NO: 6940 - protein, 135 aa, Cicer arietinum
MDLIELWAIFGPGVAGAVFGAGWWIWLDAVVCSSTTVPFLHYLPGIFASLAGLMFNCVRKEDIDYSPYDEGEWRLKLWLFIAYVVSFVSLAGSAGLLIQDSLDKSAPSVWTGVAGVLQCVFVLISGLIYWTSHPE

SEQ ID NO: 6941 - protein, 135 aa, Vigna unguiculata
MDLLELWAIFGPGVAGTVFGVGWWIWLDAVVCSSITVPFLHYLPGIFASLAALMFNCVRKEDIDYSPYDEGEWRLKLWLFIAYVVSFVSLAGSAGLLIQDSLDKSAPSVWTGVAGVLQCVCVLISGLVYWTSHPE

SEQ ID NO: 6942 - protein, 135 aa, Lotus japonicus
MDLLELWAIFGPGVAGAVFGAGWWIWLDAVVCSSTTVPFLHYLPGIFASLAALMFNCVRKEDIDYSPYDEGEWRLKLWLFIAYVVSFVSLAGSAGLLIQDSLDKSAPSVWTGVAGVLQGVLVLISGLIYWTSHPE

SEQ ID NO: 6943 - protein, 135 aa, Phaseolus vulgaris
MDVLELWAIFGPGVAGTVFGVGWWIWLDAVVCSSITVPFLHYLPGIFASLAALMFNCVRKEDIDYSPYDEGEWRLKLWLFIAYVVSFVSLAGSAGLLIQDSLDKSAPSVWTGVAGVLECVCVLISGLVYWTSHPE

SEQ ID NO: 6944 - protein, 135 aa, Glycyrrhiza uralensis
MDVMELWAIFGPGVAGAVFGAGWWIWLDAVVCSSTTVPFLHYLPGIFASLAALMFNCVRKEDIDYSPYDEGEWRLKLWLFIAYVVSFVSLAGSAGLLIQDSIDKSAPSVWTGVAGVLQCALVLISGLVYWTSHPE

SEQ ID NO: 6945 - protein, 135 aa, Unknown
  Sequence found in Organisms: Medicago truncatula, Trigonella foenum-graecum
MDLIELWAIFGPGVAGAVFGAGWWIWLDAVVCSSTTVPFLHYLPGIFASLAGLMFNCVRKEDIDYSPYDEGEWRLKLWLFIAYVVSFVSLAGSAGLLIQDSLDKSSPSVWTGIAGVLQCVFVLISGLIYWTSHPE

SEQ ID NO: 6946 - protein, 135 aa, Arachis hypogaea
MDLMELWAIFGPGVAGAVFGAGWWIWLDAVVCSSTTVPFLHYLPGIFASLAALMFNCVRKEDIDYSPYDEGEWRLKLWLFVAYVVSFVSLAGAAGLLIQDSIDQSAPSVWTGVAGVLQCVFVLISGLVYWTSHPE

SEQ ID NO: 6947 - protein, 129 aa, Pisum sativum
WAIFGPGVAGAVFGAGWWIWLDAVVCSSTTVPFLHYLPGIFASLAGLMFNCVRKEDIDYSPYDEGEWRLKLWLFIAYVVSFVSLAGSAGLLIQDSLDKSAPSVWAGVAGVLQCVFVLISGLIYWTAHPE

SEQ ID NO: 6948 - protein, 135 aa, Theobroma cacao
MDLGELWAIFGPGVAGAVFGAGWWFWIDAVVCSSVTVSFVHYLPGIFASIAALMFNCVRKEDIDYSPYEEGEWRLKLWLFFAYVVSFVSLAASVGLLIQDSLVKSGPSVWTGTAGVLQCVFVLISGLIYWTSHSE

SEQ ID NO: 6949 - protein, 135 aa, Ricinus communis
MDLPELWAIFGPGVAGAVFGAGWWFWVDAVVCSAVKVSFVHYLPGIFASIAALMFNCVRKEDIDYSPYEEGEWRLKLWLFFAYVVSFVSLAASVGLLIQDSLVKSGPSVWTGTAGVLQCVFVLISGLIYWTSHSE

SEQ ID NO: 6950 - protein, 135 aa, Castanea mollissima
MDLSELWAIFGPGVAGAVFGAGWWFWVDAVVCSSVAVSFVHYLPGIFASFAALMFNCVRKEDIDYSPYEEGEWRLKLWLFFAYVVSFVSLAASVGLLIQDSLVTTGPSVWTGTAGVLQCVFVLISGLIYWTSHPE

SEQ ID NO: 6951 - protein, 136 aa, Solanum phureja
MDFSELWAIFGPGVAGAVFGAGWWFWVDAVVCSSVKISFLHYLPGIFASLAALMFNCVRKEDIDYSPYDEGEWRLKLWLFIAYVVSFVSLAASVGLLIQDALGKSGPSAWTGVAGVLQCVFVLISGLIYWTSHSES

SEQ ID NO: 6952 - protein, 136 aa, Nicotiana tabacum
MDFPELWAIFGPGVSGAVFGAGWWFWVDAVVCSSVKVSFLHYLPGIFASLAALMFNCVRKEDIDYSPYDEGEWRLKLWLFIAYVVSFVSLAASVGLLIQDALGKSGPSAWTGVAGVLQCVFVLISGLIYWTSHSES

SEQ ID NO: 6953 - protein, 135 aa, Fagus grandifolia
MDLTELWAIFGPGVAGAVFGAGWWFWVDAVVCSSATVSFVHYLPGIFASFAALMFNCVRKEDIDYSPYEEGEWRLKLWLFFAYVVSFVSLAASVGLLIQDSLVTTGPSVWTGTAGVLQCVFVLVSGLIYWTSHPE

SEQ ID NO: 6954 - protein, 135 aa, Citrus clementina
MDLAELWAIFGPGVAGAVFGAGWWFWIDAVVCSSVKVPFVHYLPGIFASLAALMFNCVRKEDIDYSPYEEGEWRLKLWLFLAYVVSFVSLAASVGLLIQDSLVKTGPSAWTGTAGVLQCVFVLISGLIYWTSHSE

SEQ ID NO: 6955 - protein, 135 aa, Cleome spinosa
MDLVELWAIFGPGVAGAVFGAGWWFWVDAVVCSSVQVPFVHYLPGIFASLGALMFNCVRKEDIDYSPYDEGEWRLKLWLFIAYVVAFVSLAASVGLLIQDSLVKTGPSTWTGVAGIFQCVFVLISGLMYWTSHPE

SEQ ID NO: 6956 - protein, 135 aa, Linum usitatissimum
MDLLEMWAIFGPGVAGAVFGAGWWFWVDAVVCSSVQVSFVHYLPGIFASFAALMFNCVRKEDIDYSPYDEGEWRLKLWLFFAYVVSFVSLAASVGLLIQDSIVKDGPSVWTGTASVLQCVFVLISGLIYWTSHSE

SEQ ID NO: 6957 - protein, 135 aa, Linum usitatissimum
MDLLEMWAIFGPGVAGAVFGAGWWFWVDAVVCSSVQVSFVHYLPGIFASFAALMFNCVRKEDIDYSPYDEGEWRLKLWLFFAYVVSFVSLAASVGLLIQDSIVKDGPSVWAGTAGVLQCVFVLISGLIYWTSHSE

SEQ ID NO: 6958 - protein, 135 aa, Quercus alba
MDLSELWAIFGPGVAGAVFGAGWWFWVDAVVCSSVSVSFVHYLPGFFASFAALMFNCVRKEDIDYSPYEEGEWRLKLWLFFAYVVSFVSLAASVGLLIQDSLVTTGPSVWTGTAGVLQCVFVLISGLIYWTSHPE

SEQ ID NO: 6959 - protein, 136 aa, Solanum lycopersicum
MDFSEIWAIFGPGVAGAVFGAGWWFWVDAVVCSSVKISFLHYLPGIFASLAALMFNCVRKEDIDYSPYDEGEWRLKLWLFIAYVVSFVSLAASVGLLIQDALEKSGPSAWTGVAGVLQCVCVLISGLVYWTSHSES

SEQ ID NO: 6960 - protein, 126 aa, Cucurbita pepo
MDLAELWSIFGPGVAGAVFGAGWWFWVDAVVCSSVAVSFLHYLPGIFASFAALMFNCVRKEDIDYSPYEEGEWRLKLWLFFAYVVSFVSLAASVGLLIQDSVVKLAYQHGRELQEYCSVCLCWLVG

SEQ ID NO: 6961 - protein, 135 aa, Manihot esculenta
MDLMELWAIFGPGVAGAVFGAGWWFWIDAVVCSSVKVSFVHYLPGIFASIAALMFNCVRKEDIDYSPYEEGEWRLKLWLFFAYVVSFVSLAASVGLLIQDSIVKTGPSVWTGTAGVLQCVFVLISGLMYWTSHSE

SEQ ID NO: 6962 - protein, 135 aa, Gossypium hirsutum
MELGELWAIFGPGVAGAVFGAGWWFWIDAVVCSSVNVSFIHYLPGIFASIAALMFNCVRKEDIDYSPYDEGEWRLKLWLFFAYVVSFVSLAASVGLLIQDSLVKSGPSVWTGTAGILQCVFVLISGLIYWTCHSE

SEQ ID NO: 6963 - protein, 135 aa, Cucumis sativus
MDLAELWSIFGPGVAGAVFGAGWWFWVDAVVCSSVAVSFVHYLPGIFASFAALMFNCVRKEDIDYSPYEEGEWRLKLWLFFAYVVSFVSLAASVGLLIQDSVVKAGPSVWTGVAGVLQCVFVLVSGLIYWTSHSE

SEQ ID NO: 6964 - protein, 135 aa, Euphorbia peplus
MDLQELWAIFGPGVAGAVFGAGWWFWIDAVVCSSVAVPFVHYLPGIFASFAALMFNCVRKEDIDYSPYEEGEWRLKLWLFFAYVVSFVSLAASVGLLIQDSIVTMGPSVWAGTAGVLQCVFVLISGLIYWTSHTE

SEQ ID NO: 6965 - protein, 135 aa, Ipomoea nil
MDFGELWAIFGPGVAGAVFGAGWWFWVDAVVCSAVKISFLHYLPGIFASLAALMFNCVRKEDIDYSPYDEGEWRLKLWLFIAYVVSFVSLAASVGLLIQDALMQTGPSAWTGVAGVLQCVFVLISGLIYWTSHSE

SEQ ID NO: 6966 - protein, 135 aa, Unknown
  Sequence found in Organisms: Cucumis melo, Citrullus lanatus
MDLAELWSIFGPGVAGAVFGAGWWFWVDAVVCSSVAVSFVHYLPGIFASFAALMFNCVRKEDIDYSPYEEGEWRLKLWLFFAYVVSFVSLAASVGLLIQDSVVKTGPSVWTGVAGVLQCVFVLVSGLIYWTSHSE

SEQ ID NO: 6967 - protein, 135 aa, Citrus sinensis
MDLAELWAIFGPGVAGAVFGAGWWFWIDAVVCSSVKVSFVHYLPGIFASLAALMFNCVRKEDIDYSPYEEGEWRLKLWLFLAYVVSFVSLAASVGLLIQDSLVKTGPSAWTGTAGVLQCVFVLISGLIYWTSHSE

SEQ ID NO: 6968 - protein, 135 aa, Malus domestica
MDLSELWGIFGPGVAGAVFGAGWWFWVDAVVCSSVKVSFLHYLPGIFASLAALMFNCVKKEDIDYSPYEEGEWRLKLWLFIAYVVAFVSLAASVGLLIQDSLVKTGPSVWTGTAGVLQAVFVLISGLIYWTAHPE

SEQ ID NO: 6969 - protein, 135 aa, Cleome gynandra
MDLAELWAIFGPGVSGAVFGAGWWFWVDAVVCSAVQVPFVHYLPGIFASLAALMFNCVRKDDIDYSPYDEGEWRLKLWLFIAYVVAFVSLAASVGLLIQDSLEKTGPSAWTGVAGIFQCVFVLISGLMYWTSHSE

SEQ ID NO: 6970 - protein, 135 aa, Gossypium hirsutum
MDLGELWAIFGPGVAGAVFGAGWWFWVDAVVCSSVNISFVHYLPGIFASIAALMFNCVRKDDIDYSPYDEGEWRLKLWLFLAYVVSFVSLAASVGLLIQDSLVTSGPSLWTGTAGVLQCVFVLISGLIYWTSHSE

SEQ ID NO: 6971 - protein, 135 aa, Cucurbita pepo
MDLAELWSIFGPGVAGAVFGAGWWFWVDAVVCSSVAVSFVHYLPGIFASFAALMFNCVRREDIDYSPYEEGEWRLKLWLFFAYVVSFVSLAASVGLLIQDSVVKTGPSVWTGVAGVLQCVFVLVSGLIYWTSHSE

SEQ ID NO: 6972 - protein, 135 aa, Euonymus alatus
MDSAEVWAIFGPAVAGAVFGAGWWFWIDAVVCSYVTVSFVHYLPGIFASIAALMFNCVRKEDIDYSPYDEGEWRLKLWLFFAYVVSFVSLAASVGLLIQDSLVKTGPSVWTGTAGILQCVFVLISGLIYWTSHSE

SEQ ID NO: 6973 - protein, 135 aa, Gossypium raimondii
MELGELWAIFGPGVAGAVFGAGWWFWVDAVVCSSVNVSFVHYLPGIFASIAALMFNCVRKEDIDYSPYDEGEWRLKLWLFFAYVVSFVSLAASVGLLIQDSLVKSGPSMWTGTAGILQCVFVLISGLIYWTCHSE

SEQ ID NO: 6974 - protein, 135 aa, Tropaeolum majus
MDLPELWAIFGPGFAGSVFGAGWWFWIDAVVCSSVKVSFLHYLPGIFASIAALMFNCVRKEDIDYSPYEEGEWRLKLWLFFAYVVSFVSLAASVGLLIQDSLLKTGPSVWTGTAGVLQCVFVLVSGLIYWTSHSE

SEQ ID NO: 6975 - protein, 135 aa, Fragaria vesca
MDFPELWAIFGPGVAGAVFGAGWWFWVDAVVCSSVTVSFLHYLPGIFASLAALMFNCVKKDDIDYSPYEEGEWRLKLWLFIAYVVSFVSLAASVGLLIQDSLVTTGPSVWTGTAGVLQAVFVLVSGLIYWTSHPE

SEQ ID NO: 6976 - protein, 135 aa, Tripterygium wilfordii
MDLSEVWAIFGPAVAGAVFGAGWWFWIDAVVCSSVTVSFVHYLPGIFASIAAVMFNCVRKEDIDYSPYDEGEWRLKLWLFFAYVVSFVSLAASVGLLIQDSLVKTGPSSWTGTAGVLQCVFVLISGLIYWTSHSE

SEQ ID NO: 6977 - protein, 134 aa, Flaveria ramosissima
MDVSELWAIFGPGVAGAVFGAGWWFWVDAVVCSAVKVSFLHYLPGIFASLAALMFNCVRREDIDYSPYDEGEWRLKLWLFLAYVVSFVSLAASVGLLIQDALVPEGPSAWTGTAGVLQCVLVLISGSCLLDVSW

SEQ ID NO: 6978 - protein, 72 aa, Jatropha curcas
MDLAELWAIFGPGVAGAVFGTGWWFWIDAVVCSSVKASFVHYLPGIFASFAALMFNCVRKEDIDYSPYEEGE

SEQ ID NO: 6979 - protein, 135 aa, Artemisia annua
MDLAELWAIFGPGVAGAVFGAGWWFWVDAVVCSSVQVSFLHYLPGIFASLAALMFNCVRREDIDYSPYEEGEWRLKLWLFLAYVVSFVSLAASVGLLIQDALVPEGPSAWTGTAGVLQCVLVLISGLVYWTSHSE

SEQ ID NO: 6980 - protein, 135 aa, Unknown
  Sequence found in Organisms: Cannabis sativa, Humulus lupulus
MDLVELWAIFGPGVSGAIFGAGWWFWIDAVVCSSVKVSFLHYLPGIFASLAALMFNCVRKEDIDYSPYEEGEWRLKLWLFFAYVVSFVSLAASVGLLIQDSLVKTGPSVWTGTAGVLQCVFVLVSGLMYWTVHSE

SEQ ID NO: 6981 - protein, 135 aa, Chelidonium majus
MDLLELWAIFGPGIAGAIFGAGWWFWVDAVVCSYVTVSFVHYLPGIFASLAALMFNCVKKEDIDYSPYEEGEWRLKLWLFVAYVVSFVSLAASVGLLVQDALVQSGPSVWTGTAGVLQCVFVLISGLVYWTSYSE

SEQ ID NO: 6982 - protein, 135 aa, Cichorium intybus
MDLSELWAIFGPGVAGAVFGAGWWFWVDAVVCSSVQVSFLHYLPGIFASLAALMFNCVRREDIDYSPYEEGEWRLKLWLFLAYVVSFVSLAASVGLLIQDALVPEGPSAWTGTAGVLQCVLVLISGLVYWTSHSE

SEQ ID NO: 6983 - protein, 135 aa, Unknown
  Sequence found in Organisms: Gossypium hirsutum, Gossypium raimondii
MDLGELWAIFGPGVAGAVFGTGWWFWVDAVVCSSVNVSFVHYLPGIFASLAAVMFNCVKKDDIDYSPYDDGEWRLKLWLFVAYVVSFVSLAASVGLLIQDSLVKSGPSVWTGTAGVLQCVFVLISGLIYWTSHSE

SEQ ID NO: 6984 - protein, 135 aa, Gossypium hirsutum
MELGELWAIFGPGVAGAVFGAGWWFWVDAVICSSVNVSFVHYLPGIFASIAALMFNCVRKEDIDYSPYDEGEWRLKLWLFFAYVVSFVSLAASVGLLIQDSLVKSGPSMWTGTAGILQCVFVLISGLIYWTCHSE

SEQ ID NO: 6985 - protein, 135 aa, Eucalyptus grandis
MDLSELWAIFSPGFAGAVFGAGWWFWVDAVVCSSVTVSFVHYLPGIFASLAALMFNCVRREDIDYSPYDDGEWRLKLWLFFAYVVSFVSLAASVGLLIQDSLVTTGPSVWTGVAGVLQCVFVLISGLIYWTAHSE

SEQ ID NO: 6986 - protein, 135 aa, Flaveria ramosissima
MDVSELWAIFGPGVAGAVFGAGWWFWVDAVVCSAVKVSFLHYLPGIFASLAALMFNCVRREDIDYSPYDEGEWRLKLWLFLAYVVSFVSLAASVGLLIQDALVPEGPSAWTGTAGVLQCVLVLISGLVYWTSHGE

SEQ ID NO: 6987 - protein, 135 aa, Gossypium raimondii
MDLGELWAIFSPGVAGAVFGAGWWFWVDAVVCSSVNISFVHYLPGIFASIAALMFNCVRKDDIDYSPYDEGEWRLKLWLFLAYVVSFVSLAASVGLLIQDSLVTSGPSLWTGTAGVLQCVFVLISGLIYWTSHSE

SEQ ID NO: 6988 - protein, 135 aa, Vitis vinifera
MDLAELWAIFGPGIAGAIFGAGWWFWVDAVVCSSVKVSFVHYLPGIFASLAAVMFNSVRKEDIDYSPYEEGEWRLKLWLFFAYVVSFVSLAASVGLLIQDSLEKSGPSVWTGTAGVLQCVFVLISGLIYWTSHSE

SEQ ID NO: 6989 - protein, 135 aa, Populus trichocarpa
MDLPELWAILGPAVAGAVFGTGWWFWIDAVVCSSVTVSFVHYLPGIFASIAALMFNCVRKEDIDYSPYEEGEWRLKLWLFFAYVVSFVSLAASVGLLIQDSIVKTGPSVWTGTAGVLQCVFVLISGLIYWTSHSE

SEQ ID NO: 6990 - protein, 135 aa, Papaver somniferum
MDPGELWAIFGPGFAGAVFGAGWWFWVDAVVCSAVAVSFVHYLPGIFASFAALMFNCVRKEDIDYSPYEEGEWRLKLWLFFAYVVSFVSLAASVGLLIQDALVETGPSAWTGTAGVLQCVFVLISGLVYWTSHTE

SEQ ID NO: 6991 - protein, 135 aa, Thalictrum flavum
MDLGELWAIFGPGVSGAVFGAGWWFWVDAVVCSSVKVSFVHYLPGIFASLAALMFNCVRREDIDYSPYEEGEWRLKLWLFFAYVVSFVSLAASVGLLVQDSLVKSGPSVWTGTAGVLQCVLVLISGLMYWTSHSE

SEQ ID NO: 6992 - protein, 136 aa, Nicotiana benthamiana
  misc_feature (28)..(28): Xaa can be any naturally occurring amino acid
  misc_feature (56)..(56): Xaa can be any naturally occurring amino acid
MDFPELWAIFGPGVSGSVFGAGWWFWVXAVVCSSIKVSFLHYLPGIFASLAALMFXCVRKEDIDYSPYDEGEWRLKLWLFIAYVVSFVSLAASVGLLIQDALGKSGPSAWTGVAGVLQCVFVLISGLIYWTSHSES

SEQ ID NO: 6993 - protein, 135 aa, Amsonia hubrichtii
MDLGELWAIFGPGVAGAVFGTGWWFWVDAVVCSSVKVSFLHYLPGIFASLAALMFNCVRREDIDYSPYEEGEWRLKLWLFIAYVVSFVSLAASVGLLIQDALVTTGPSAWTGVAGVLQCVFILVSGLIYWTSHTE

SEQ ID NO: 6994 - protein, 135 aa, Unknown
  Sequence found in Organisms: Brassica napus, Brassica juncea, Brassica rapa, Raphanus sativus
MDLAELWAIFGPGFSGAVFGTGWWFWVDAVVCSSIQVPFLHYLPGIFASLGALMFNCVRKEDIDYSPYDEGEWRLKLWLFIAYVVAFVSLAASVGLLIQDSVVKTGPSTWTGVAGVFQCVFVLISGLMYWTSHSE

SEQ ID NO: 6995 - protein, 135 aa, Catharanthus roseus
MDLGELWAIFGPGVAGAVFGTGWWFWVDAVVCSSVKVPFLHYLPGIFASLAALMFNCVRREDIDYSPYEEGEWRLKLWLFIAYVISFVSLAASVGLLIQDALVKTGPSAWTGVAGVLQCVSILVSGLIYWTSHTE

SEQ ID NO: 6996 - protein, 135 aa, Cirsium arvense
MDLLELWGIFGPGVAGAVFGAGWWFWVDAVVCSSVKISFLHYLPGIFASLAALMFNCVRREDIDYSPYEEGEWRLKLWLFLAYVVSFVSLAASVGLLIQDALVPEGPSAWTGTAGVLQCVLVLISGLVYWTSHSE

SEQ ID NO: 6997 - protein, 135 aa, Taraxacum officinale
MDLSELWAIFGPGVAGAVFGVGWWFWVDAVVCSSVQVSFLHYLPGIFASLAALMFNCVRREDIDYSPYEEGEWRLKLWLFLAYVVSFVSLAASVGLLIQDALVPEGPSAWTGTAGVLQCVLVLISGLVYWTSHSE

SEQ ID NO: 6998 - protein, 135 aa, Eschscholzia californica
MDLGELWAIFGPGFSGAIFGAGWWFWVDAVVCSSVTVSFVHYLPGIFASLAALMFNCVRKEDIDYSPYEEGEWRLKLWLFFAYVVSFVSLAASVGLLVQDSVVKTGPSVWTGTAGVLQCVFVLISGLAYWTSHSE

SEQ ID NO: 6999 - protein, 135 aa, Euonymus alatus
MDLAEAWPIFGPGVAGIVFGAGWWFWIDAVVCSSVAVSFVHYLPGIFASIAAVMFNCVRKEDIDYSPYDEGEWRLKLWLFFAYVVSFVSLAASVGLLIQDSLVKSGPSSWTGTAGVLQCVFVLISGLIYWTSHSD

SEQ ID NO: 7000 - protein, 135 aa, Euonymus alatus
MDLAEAWPIFGPGVAGIVFGAGWWFWIDAVVCSSVAVSFVHYLPGIFASIAALMFNCVRKEDIDYSPYDEGEWRLKLWLFFAYVVSFVSLAASVGLLIQDSLVKTGPSVWTGTAGIMQCVFVLISGLIYWTSHSE

SEQ ID NO: 7001 - protein, 135 aa, Unknown
  Sequence found in Organisms: Euphorbia peplus, Euphorbia esula
MDLQELWAIFGPGVAGTIFGAGWWFWIDAVVCSSVAVPFVHYLPGIFASIAALMFNCVRKEDIDYSPYEEGEWRLKLWLFFAYVVSFVSLAASVGLLIQDSIVTTGPSVWAGTAGVLQCVFVLISGLIYWTSHSE

SEQ ID NO: 7002 - protein, 142 aa, Fagopyrum esculentum
MDISELWAIFGPGVAGAVFGAGWWFWVDAVVCSSVAISFVHYLPGIFASLAALMFNCVRKEDIDYSPYDEGEWRLKLWLFLAYVVSFVSLAASVGLLIKDALETSGPSAWTGTAGVLQCVFVLISGLVYWTSHSDQGGNAWY

SEQ ID NO: 7003 - protein, 135 aa, Actinidia deliciosa
MDLTELWAIFGPAVAGAVFGAGWWFWVDAVVCSSVQVSFLHYLPGIFASLAALMFNCVRREDIDYSPYEEGEWRLKLWLFLAYVVSFVSLAASVGLLIQDALVTTGPSAWTGTAGVLQCVFVLISGLIYWTSHIE

SEQ ID NO: 7004 - protein, 135 aa, Lactuca sativa
MDLSELWAIFGPGFAGAVFGAGWWFWVDAVVCSSVQVSFLHYLPGIFASLAALMFNCVRREDIDYSPYEEGEWRLKLWLFLAYVVSFVSLAASVGLLIQDALVPEGPSAWTGTAGVLQCVLVLISGLVYWTSHSE

SEQ ID NO: 7005 - protein, 135 aa, Raphanus sativus
MDLAELWAIFGPGFSGAVFGTGWWFWVDAVVCSSIQVPFLHYLPGIFASLGALMFNCVRKEDIDYSPYDEGEWRLKLWLFIAYVVAFVSLAASVGLLIQDSVVKTSPSTWTGVAGVFQCVFVLISGLMYWTSHSE

SEQ ID NO: 7006 - protein, 135 aa, Helianthus annuus
MDVSELWAIFGPGVAGAVFGAGWWFWVDAVVCSAVKVSFLHYLPGIFASLAALMFNCVRRDDIDYSPYEEGEWRLKLWLFLAYVVSFVSLAASVGLLIQDALLPEGPSAWTGTAGVLQCVFVLISGLVYWTSHSE

SEQ ID NO: 7007 - protein, 135 aa, Valeriana officinalis
MDLAELFVIFGPGVSGAVFGAGWWFWIDAVVCSAVKVSFLHYLPGIFASLAALMFNCVKREDIDYSPYEEGEWRLKLWLFIAYVVSFVSLAASVGLLIQDSLVTTGPSAWTGVAGVLQCVFVLISGLIYWTSHAE

SEQ ID NO: 7008 - protein, 135 aa, Vinca minor
MDLGELWTIFGPGFAGAVFGAGWWFWVDAVVCSSVKVSFLHYLPGIFASLAALMFNCVRREDIDYSPYEEGEWRLKLWLFIAYVVSFVSLAASVGLLIQDALVKTGPSAWTGVAGVLQCVFILVSGLIYWTSHTE

SEQ ID NO: 7009 - protein, 135 aa, Unknown
  Sequence found in Organisms: Centaurea maculosa, Cirsium arvense
MDLLELWGIFGPGVAGAVFGAGWWFWVDAVVCSSVKISFLHYLPGIFASLAALMFNCVRREDIDYSPYEEGEWRLKLWLFLAYVVSFVSLAASVGLLIQDALVPEGPSAWTGTAGVLQCVLVLISGLAYWTSHSE

SEQ ID NO: 7010 - protein, 135 aa, Unknown
  Sequence found in Organisms: Prunus persica, Prunus persica
MDVSELWAIFGPGVAGAVFGAGWWFWVDAVVCSSVKVSFVHYLPGIFASLAALMFNCVKKEDIDYSPYEESEWRLKLWLFIAYVVAFVSLAASVGLLIQDSLVTTGPPVWTGVAGVLQSVFVLISGLIYWTAHPE

SEQ ID NO: 7011 - protein, 135 aa, Ambrosia trifida
MDVSELWAIFGPGVAGAVFGAGWWFWVDAVVCSAVKVSFLHYLPGIFASLAALMFNCVRRDDIDYSPYEDGEWRLKLWLFLAYVVSFVSLAASVGLLIQDTLMPEGPSAWTGTAGVLQCVFVLISGLVYWTSHSE

SEQ ID NO: 7012 - protein, 135 aa, Unknown
  Sequence found in Organisms: Arabidopsis thaliana, Arabidopsis lyrata
MDLAELWAIFGPGFSGAVFGTGWWFWVDAVVCSSIQVPFVHYLPGIFASLGALMFNCVRKEDIDYSPYDEGEWRLKLWLFIAYVVAFVSLAASVGLLIQDSVVKTGPSTWTGVAGVFQCVFVLISGLMYWTSHSE

SEQ ID NO: 7013 - protein, 135 aa, Aristolochia fimbriata
MDFADLWAIFGPGVAGAVFGAGWWFWVDAVVCSAVKVSFVHYLPGIFASLAALMFNCVRKEDIDYSPYEEGEWRLKLWLFLAYVVSFVSLAASVGLLIQDALTSSGPSAWTGTAGVLQCVLVLISGLMYWTSHSE

SEQ ID NO: 7014 - protein, 135 aa, Brassica oleracea
MDLAELWAIFGPGFSGAVFGTGWWFWVDAVVCSSIQVPFLHYLPGIFASLGALMFNCVRKEDIDYSPYDEGEWRLKLWLFIAYVVAFVSLAASVGLLIQDSVVKTGPSTWTGVAGIFQCVFVLISGLMYWTSHSE

SEQ ID NO: 7015 - protein, 135 aa, Vaccinium corymbosum
MDFGELWAIFGPAVAGAVFGAGWWFWIDAVVCSSVAVSFLHYLPGIFASLAALMFNCVRREDIDYSPYEEGEWRLKLWLFLAYVVSFVSLAASVGLLIQDALTDTGPSSWTGTAGVLQCVFVLISGLIYWTSHSE

SEQ ID NO: 7016 - protein, 135 aa, Cleome spinosa
MDMTELWAIFGPGVSGAVFGAGWWFWVDAVVCSSVQVPFVHYLPGISASLAALMFNCVRKEDIDYSPYDDGEWRLKLWLFITYVVAFVSLAASVGLLIQDSLVKTGPSAWTGVAGIFQCVFVLISGLMYWTSHSE

SEQ ID NO: 7017 - protein, 135 aa, Euonymus alatus
MDLAEAWPIFGPGVAGIVFGAGWWFWIDAVVCSSVAVSFVHYLPGIFASIAAVMFNCVRKEDIDYSPYDEGEWRLKLWLFFAYVVSFVSLAASVGLLIQDSLVKTGPSSWTGTAGVLQCVFVLISGLIYWTSHSD

SEQ ID NO: 7018 - protein, 135 aa, Flaveria ramosissima
MDFSELWAIFGPGVAGAVFGAGWWFWVDAVVCSSVKVSFLHYLPGIFASLAALMFNCVKREDIDYSPYEEGEWRLKLWLFLAYVVSFVSLAASVGLLIQDALVPEGPSAWTGTAGVLQCVLVLISGLVYWTSHSE

SEQ ID NO: 7019 - protein, 135 aa, Guizotia abyssinica
MDLSELWAIFGPGVSGAVFGAGWWFWVDAVVCSSVQVSFLHYLPGIFASLAALMFNCVRRDDIDYSPYEEGEWRLKLWLFLAYVVSFVSLAASVGLLIQDALVPEGPSAWTGTAGVLQCVLVLISGLVYWTSHSE

SEQ ID NO: 7020 - protein, 135 aa, Platanus occidentalis
MDLGELLAIFGPGIAGAVFGAGWWFWVDAVVCSSVKVSFVHYLPGIFASLAALMFNCVRREDIDYSPYEEGEWRLKLWLFFAYVVSFVSLAASVGLLIQDSLVKSGPSVWTGVAGVLQCVLVLISGLIYWACHSD

SEQ ID NO: 7021 - protein, 135 aa, Populus trichocarpa
MDLPELWAIFGPGVAGAVFGAGWWFWIDAVVCGSVTVSVVHYLPGIFASIASLMFNCVRKEDIDYSPYEEGEWRLKLWLFFAYVVSFVSLAASVGLLIQDSIVKTGPSVWTGTAGVLQCVFVLISGLICWTSYSE

SEQ ID NO: 7022 - protein, 135 aa, Populus trichocarpa
MDLPELWAIFGPGVAGAVFGAGWWFWIDAVVCSSVTVSVVHYLPGIFASIASLMFNCVRKEDIDYSPYEEGEWRLKLWLFFAYVVSFVSLAASVGLLIQDSIVKTGPSVWTGTAGILQCVFVLISGLICWTSYSE

SEQ ID NO: 7023 - protein, 135 aa, Scabiosa columbaria
MDLGELFAIFGPGVSGAVFGAGWWFWIDAVVCSSVKVSFLHYLPGIFASLAALMFNCVKREDIDYSPYEEGEWRLKLWLFIAYVVSFVSLAASVGLLIQDALVTTGPSAWTGTAGVLQCVFVLISGLIYWTSHSE

SEQ ID NO: 7024 - protein, 130 aa, Tabernaemontana elegans
MWAIFGPGVAGAVFGAGWWFWVDAVVCSSVKVSFLHYLPGIFASLAALMFNCVRREDIDYSPYEEGEWRLKLWLFIAYVVSFVSLAASVGLLIQDALVKTGPSAWTGVAGVLQCVFVLISGLIYWTSHAE

SEQ ID NO: 7025 - protein, 135 aa, Eutrema halophilum
MDLVELWAIFGPGFSGAIFGTGWWFWVDAVVCSSIQVPFLHYLPGIFASLGALMFNCVRKEDIDYSPYDEGEWRLKLWLFIAYVVAFVSLAASVGLLIQDSVAKTGPSTWTGVAGVFQCVFVLISGLMYWTSHSE

SEQ ID NO: 7026 - protein, 135 aa, Eutrema parvulum
MDLAELWGIFGPGFSGAVFGTGWWFWVDAVVCSSIQVPFLHYLPGIFASLGALMFNCVRKEDIDYSPYDEGEWRLKLWLFIAYVVAFVSLAASVGLLIQDSVVKTGPSTWTGVAGVFQCVFVLISGLMYWTSHSE

SEQ ID NO: 7027 - protein, 135 aa, Utricularia gibba
MEFGELMAIFGPGVAGAIFGTGWWFWVDAVVCSAVGVPFVHYLPGIFASFAALMFNCVRKGDLDYSPYDDGDWRLKLWLFIAYVVSFVSLAASVGLLIQDALVKSGPSAWTGVAGVLQCVFVLISGLIYWISHPE

SEQ ID NO: 7028 - protein, 135 aa, Juglans hindsii x Juglans regia
MDFSELWAIFGPGVAGAVFGTGWWFWVDAVVCSSVKVSFVHYLPGIFATFAALMFNCVRKEDIDYSPYEEGEWRLKLWLFFAYVVSFVSLAASVGLLIQDSIVTTGPSVWTGTAGVLQCVFVLVSGLIYWTAHPE

SEQ ID NO: 7029 - protein, 142 aa, Fagopyrum esculentum
MDISELWAIFGPGVAGAVFGAGWWFWVDAVVCSSVAISFVHYLPGIFASLAALMFNCVRKEDIDYSPYDEGEWRLKLWLFLAYVVSFVSLAASVGLLIKDALETSGPSAWTGTAGVLQCVFVLVSGLVYWTSHSDQGGNAWY

SEQ ID NO: 7030 - protein, 136 aa, Helianthus annuus
MDFSELWAIFGPGVAGAVFGAGWWFWVDAVVCSSVQVSFLHYLPGIFASLAALMFNCVRRDDIDYSPYEEGEWRLKLWLFLAYVVSFVSLAASVGLLIQDALVPEGPSAWTGTAGVLQCVLVLISGLVYWTSHSEQ

SEQ ID NO: 7031 - protein, 112 aa, Ambrosia trifida
AGGSTVEVDLQQLIRSISPTVDIYHKSRIDQWNCLNCGQVFGPGVAGAVFGAGWWFWVDAVVCSSVLSLLSSLPSWNICIFGLLCMFNCVRREDIDYSPYEEGEWRLKLWLF

SEQ ID NO: 7032 - protein, 122 aa, Helianthus annuus
MDLSELWTIFGPGVAGAVFGAGWWFWVDAVVCSSVQVSFLHYLPGIFASLAALMFNCVRRDDIDYSPYEEGEWRLKLWLFLAYVVSFVSLAASVGLLIQDALVPEGPSAWTGTAGVLQCVLV

SEQ ID NO: 7033 - protein, 135 aa, Antirrhinum majus
MDLGELLAIFGPGISGAVFGAGWWFWVDAVVCSSVQIPFLHYLPGIFASFAALMFNCVRKDDLDYSPYDEGEWRLKLWLFIAYVVSFVSLAASVGLLIQDAMLESGPSAWTGVAGIFQCVFVLISGLIYWVSHSE

SEQ ID NO: 7034 - protein, 135 aa, Cynara scolymus
MDLSELWGIFGPGVAGAVFGAGWWFWVDAVVCSSVKISFLHYLPGIFASLAALMFNCVRREDIDYSPYEEGEWRLKLWLFLAYVVSFVSLAASVGLLIQDALVPEGPSAWAGTAGVLQCVLVLISGLVYWTSHSE

SEQ ID NO: 7035 - protein, 135 aa, Flaveria ramosissima
MAFSELWAIFGPGVAGAVFGAGWWFWVDAVVCSSVKVSFLHYLPGIFASLAALMFNCVKREDIDYSPYEEGEWRLKLWLFLAYVVSFVSLAASVGLLIQDALVPEGPSAWTGTAGVLQCVLVLISGLVYWTSHSE

SEQ ID NO: 7036 - protein, 135 aa, Plantago ovata
MDLSELLAIFGPGISGAVFGTGWWFWVDAVVCSSVQVPFVHYLPGIFASLAALMFNCVRKEDIDYSPYEEGEWRLKLWLFIAYVVSFVSLAASVGLLVQDALVDSGPSSWTGVAGILQCVFVLISGLIYWISHSE

SEQ ID NO: 7037 - protein, 129 aa, Rhizophora mangle
MDLSELWAIFGPGFAGAVFGAGWWFWVDAVVCSSVKVSFVHYLPGIFASIAALMFNCVRKEDIDYSPYEEGEWRLKLWLFFAYVVSFVSLAASVGLLIQDSLVKSGPSVWTGTAGVLQCVFVLVSGLIY

SEQ ID NO: 7038 - protein, 131 aa, Silene vulgaris
ELLAIFGPGISGAVFGAGWWFWVDAVVCSAVAISFLHYLPGIFASLAALMFNCVRKEDIDYSPYDEGEWRLKLWLFIAYVVAFVSLAASVGLLIQDALVPSGPSTWTGVAGVLQCVFVLISGLIYWTSHLE

SEQ ID NO: 7039 - protein, 135 aa, Silene vulgaris
MEISELMAIFGPGIAGAVFGTGWWFWVDAVVCSAVAISFLHYLPGIFASLAALMFNCVRKEDIDYSPYDEGEWRLKLWLFIAYVVAFVSLAASVGLLIQDALVPSGPSAWTGVAGVLQCVFVLISGLIYWSSHTE

SEQ ID NO: 7040 - protein, 135 aa, Camellia sinensis
MDLIELWAIFGPAVAGAVFGAGWWFWVDAVVCSSVAVSFLHYLPGIFASLAALMFNCVRREDIDYSPYEEGEWRLKLWLFLAYVISFVSLAAAVGLLIQDALVETGPSAWTGTAGVLQCVFVLISGLIYWTSHSE

SEQ ID NO: 7041 - protein, 135 aa, Beta vulgaris
MDIPELLAIFGPGFAGAVFGAGWWFWVDAVVCSAVAVSFVHYLPGIFASLSALMFNCVRKEDIDYSPYDEGEWRLKLWLFLAYVISFVSLAASVGLLIQDALVPTGPSAWTGTAGVLQCVFVLISGLIYWTSHSE

SEQ ID NO: 7042 - protein, 135 aa, Raphanus sativus
  misc_feature (63)..(63): Xaa can be any naturally occurring amino acid
  misc_feature (69)..(69): Xaa can be any naturally occurring amino acid
  misc_feature (119)..(119): Xaa can be any naturally occurring amino acid
MDLAELWAIFGPGFSGAVFGTGWWFWVDAVVCSSIQVPFLHYLPGIFASLGALMFNCVRKEDXDYSPYXEGEWRLKLWLFIAYVVAFVSLAASVGLLIQDSVVKTGPSTWTGVAGVFQXVFVLISGLMYWTSHSE

SEQ ID NO: 7043 - protein, 135 aa, Rosa hybrid cultivar
MDMPELWAIFGPGFAGAVFGAGWWFWVDAVVCSSVTVSFVHYLPGIFASLAALMFNCVKKDDIDYSPYEEGEWRLKLWLFIAYVVSFVSLAASVGLLIQDSLETTGPSVWTGTAGVLQAVFVLVSGLIYWTAHSQ

SEQ ID NO: 7044 - protein, 130 aa, Sesamum indicum
MNLAELLAIFGPGVAGAVFGAGWWFWVDAIVCSSVQVPFVHYLPGIFASLSALMFNCVRKEDIDYSPYEDGEWRLKLWLFIAYVVSFVSLAASVGLLIQDTLVKSGPSAWTGVAGVLQCVFVLISGLIYW

SEQ ID NO: 7045 - protein, 52 aa, Carthamus tinctorius
MDLLELWGIFGPGVAGAVFGAGWWFWVDAVVCSSVKISFLHYLPGNLHLWLL

SEQ ID NO: 7046 - protein, 62 aa, Lippia dulcis
MELSELLAIFGPGISSAVFGAGCGLGGCRRVQRRTSPFPPLPARNFRFAVCFDVQLREERRY

SEQ ID NO: 7047 - protein, 134 aa, Triphysaria pusilla
MDLRELLAIFGPGVAGAVFATGWWFWVEAVVCSSVKISFVHYLPGIFASLAALMFNCVRKEDIDYSPYEEGEWRLNFGFHCICCSLCLISCFSWSIDTRFPLKSGPSTWAGVAGVLQCVFVLISGLIYWISHSE

SEQ ID NO: 7048 - protein, 135 aa, Olea europaea
MDLGELWAIFGPGFAGAVFGAGWWFWVDAVVCSSVKVSFLHYLPGIFASLAALMFNTVNKEDLDDSPYGESEWRVKLWLFIAYVVSFVCLAASVGLLIQDALVESGPSAWTGVAGVFQCVFVLISGLMYWTSHSE

SEQ ID NO: 7049 - protein, 135 aa, Amorphophallus konjac
MDYGELWAIFGPGIAGAVFGVGWWLWVDAVVCSAVKVSFLHYLPGIFASLAALMFNCVKKEDIDYSPYEEGEWRVKLWLFLAYVVSFVSLAASVGLLVQDALTDKGISAWTGVAGVLQCVFVLISGLIYWTSHSE

SEQ ID NO: 7050 - protein, 135 aa, Mimulus guttatus
MDLSELLAIFGPGVSGAVFATGWWFWVDAVVCSSVKVPFVHYLPGIFASLSALMFNSVNKEDIDYSPYAEGEWRLKLWLFIAYVVSFVSLAASVGLLIQDALVESGPSAWAGVAGVLQCVFVLISGLIYWISHSE

SEQ ID NO: 7051 - protein, 135 aa, Orobanche aegyptiaca
MDLGEMLAIFGPAISGAVFGAGWWFWVDAVVCSSIKIPFLHYLPGIFASLAALMFNCVRKDDIDYSPYEESEWRLKLWLFIAYVVSFVSLAASVGLLIQDALVESGPSAWTGVAGVLQCVFVLISGLIYWISHTE

SEQ ID NO: 7052 - protein, 135 aa, Lippia dulcis
MDLKEMLAIFGPGISGGVFGAGWWFWVDAVVCSSVKIPFVHYLPGIFASLSALMFNCVRKEDIDYSPYDDGEWRLKLWLFIAYVVSFVSLAASVGLLIQDALVESGPSAWTGVAGVLQCVFVLISGLIYWISHSD

SEQ ID NO: 7053 - protein, 133 aa, Platanus occidentalis
LRELSAIFGPGVAGAVFGVGWWFWVDAVVCSSVKVSFVHYLPGIFASIAALMFNCVRREDIDYSPYEEGEWRLKLWLFFAYIVSFVSLAASVGLLVQDSLVKSGASVWTGVAGVLQCVFVLISGLIYWTAHSD

SEQ ID NO: 7054 - protein, 135 aa, Fraxinus spp
LAELWAIFGPGVAGAVFGAGWWFWVDAVVCSSVKVPFVHYLPGIFASLAALMFNCVKKDDIIDHYSPYDEGEWRGKLWLFIAYIVSFISLAASVGLLIQDALVKTGPSAWTGVAGVLQCVFVLISGLMYWTCNSE

SEQ ID NO: 7055 - protein, 135 aa, Bruguiera gymnorhiza
MDLSELWAILGPGLAGSVFAAGWWFWIDAVVCSSVKVSFWHYLPGIFASIAALMFNCVKKEDIDYSPYEEGEWRLKLWLFFAYVVSFVSLAASVGLLIRDSIVNSGTSVWTGTAGVLQCVFVLTSGLLYWTSHSE

SEQ ID NO: 7056 - protein, 136 aa, Primula obconica
MDLGELWAIFGPAISGAVFGAGWWFWVDAVVCSAVAVSFLHYLPGIFASLAAVMFNCVRREDIDYSPYEEGEWRLKLWLFLAYVVSFVSLAASVGLLIQDALVTTGPSAWTGTAGVLQCVLVLISGLIYWTSHSSE

SEQ ID NO: 7057 - protein, 129 aa, Sesamum indicum
MNLAELLAIFGPGVAGAVFGAGWWFWVDAIVCSSVQVPFVHYLPGIFASLSALMFNCVRKEDIDYSPYEDGEWRLKLWLFIAYVVSFVSLAASVGLLIQDALVESGPSAWTGVAGVLQCVFVLISGLIY

SEQ ID NO: 7058 - protein, 109 aa, Glycine max
MDGLQRSEVSFRRQGSSGLVWDDKLLSGELNKVNNNEDQKGGGSGGDLNLKVRTTPPNTTIQRSRSNGGYRTGKVSPAIEPPSPKLSACGFCSAFGKTREKGRAKHRSR

SEQ ID NO: 7059 - protein, 288 aa, Glycine max
MRKRSIYAWLVALVCFLLLMIVTPAIPQSQEYHDFADHRTFLGIPNALNVISNFPFLVIGLVGLVLCHHGNYFRLSLQGELWGWTCFYVGVAAVAVGSSYYHLKPDDARLVWDRLPMTVAFTSIMAIFIIERIDERKGTVSIIPLVLAGIISIVYWRFFDDLRPYALVQFVPCIVIPLMAILLPPMYTHSTYWLWAAGSYLLAKVLEATDDVIYEWAQHIVSGHTLKHLVAAMVPVFLTFMLAKRSVEPERQSLLKTWRVSWTKFREGNSNIESYSYSYTNVQAVEPQ

SEQ ID NO: 7060 - protein, 288 aa, Cajanus cajan
MRNRSVYAWAVALVCFLVLMIVTPAIPQSQEYHNFADHRTFFGIPNALNVISNFPFLVIGLIGLVLCHHGNYFRLSLQGELWGWTCFYVGVAAVAVGSSYYHLKPDDARLVWDRLPMTVAFTSIIAIFIIERIDERKGMISIIPLILAGIISIVYWRFFDDLRPYALIQFVPCIAIPLMAILLPPMYTHSTYWLWAAGSYLLAKVLEATDEVIYEWTHHIVSGHTLKHLCAAMVPVFLTFMLAKRTVEPERQSLLKTWRVSWTKFREGNSKVESYTYSYSNVQTVEPQ

SEQ ID NO: 7061 - protein, 287 aa, Vigna unguiculata
MRNRSLYAWLVALFCFLVLMIVTPAIPQSQEYHNFADHRKFLGIPNALNVISNFPFLVIGLVGLVLCYRGNYFRLSLEGEIWGWTCFYVGVAAVAVGSSYYHLKPDDARLVWDRLPMTIAFTSIIAIFIIERIDERKGTVSIIPLLLAGIISIVYWRFFDDLRPYALVQFVPCIAIPLMAILLPPMYTHSTYWLWAAGFYLLAKVLEATDEVIYGWTHHIVSGHTLKHLAAAMVPVFLTFMLAKRDVEPERQNLLKTWRVSWMKFREGNSNVESYSYSYSTVPVVEK

SEQ ID NO: 7062 - protein, 288 aa, Phaseolus vulgaris
MRNRSVYASLVALFCFLVLMIVTPAIHQSQDYHNFADHRKFFGIPNALNVISNFPFLVIGLVGLVLCHRGNYFSLSLQGEIWGWTCFYVGVAAVAVGSSYYHLKPDDARLVWDRLPMTVAFTSIIAIFIIERIDEWKGTVSIIPLLLAGIISIVYWRFFDDLRPYALVQFVPCIAIPLMAILLPPMYTHSTYWLWAAGSYLLAKVLEATDEVVYEWTHHIVSGHTLKHLAAAMVPVFLTFMLAKRSVQPERQNLLKTWRVSWVKFRQGNSNVESYSYSYTDVPVVEPH

SEQ ID NO: 7063 - protein, 282 aa, Phaseolus vulgaris
MHRWLHFFCFLVLMIVTPAIHQSQDYHNFADHRKFFGIPNALNVISNFPFLVIGLVGLVLCHRGNYFSLSLQGEIWGWTCFYVGVAAVAVGSSYYHLKPDDARLVWDRLPMTVAFTSIIAIFIIERIDEWKGTVSIIPLLLAGIISIVYWRFFDDLRPYALVQFVPCIAIPLMAILLPPMYTHSTYWLWAAGSYLLAKVLEATDEVVYEWTHHIVSGHTLKHLAAAMVPVFLTFMLAKRSVQPERQNLLKTWRVSWVKFRQGNSNVESYSYSYTDVPVVEPH

SEQ ID NO: 7064 - protein, 286 aa, Medicago truncatula
MRKRVVYAWAVALICFIVLMIVTPAIPQSQDYHNFADQRTFFGIPNALNVISNFPFLIIGLIGLVLCHHGNYFKLSLQGELWGWTCFYVGVAAVGIGSSYYHLKPDDASLVWDRLPMTVAFTSIIAIFIIERIDERKGMISIIPLVLAGVISIVYWRFFDDLRPYALIQFVPCIAIPLMAILLPPMYTHSTYWLWAAGFYLLAKVLEATDDVVYKWTHHIVSGHTLKHLFAAMVPVFLTFMLAKRSVEPERQSLFKVWRISWTKVKEGDSNVESYTYSRVEVEEPQ

SEQ ID NO: 7065 - protein, 288 aa, Arachis hypogaea
MRKRTVLAWVVAVVCFVVLMIVTPAIPQSQEYHDFADQRTFFGIPNALNVISNFPFMIIGLIGVILCHHGNYFKLSLQGELWGWTCFYVGVAAVAVGSSYYHLKPDDARLVWDRLPMTIAFTSIVAIFIIERIDERKGMISIIPLLLIGIISIVYWRFFDDLRPYAVVQFAPCIAIPLMAILLPPMYTHSTYWLWAAGFYLLAKVLEAADKVIYEWTHHVVSGHTLKHLSAAMVPVFLTLMLAKRSVDSERQSLLKTWRVSWTKYREGNSNVESYTISYSNVPVEEPQ

SEQ ID NO: 7066 - protein, 285 aa, Trigonella foenum-graecum
MRKRIVYAWAVALICFIVLMIVTPAIPQSQDYHNFADQRTFFGIPNALNVISNFPFLIIGLIGLILCHHGNYFKLSLQGELWGWTCFYVGVAAVGIGSSYYHLKPDDASLVWDRLPMTIAFTSIIAIFIIERIDERKGMVSIIPLILAGIISIVYWRFFDDLRPYALVQFVPCIAIPLMAILLPPMYTHSTYWLWAAGFYLLAKVLEATDDVVYKWTHHIVSGHTLKHLFAAMVPVFLTFMLAKRSVEPERQSLYKIWRISWTKVKEGDSNVEYTYSRVEVEEPQ

SEQ ID NO: 7067 - protein, 286 aa, Cicer arietinum
MRKRIVSAWGVALICFIVLMIVTPTIPQSQEYHNFADQRTFFGIPNALNVISNFPFLVVGLIGLILCYHGNYFKLSLQGELWGWTCFYLGVAAVGVGSSYYHLKPDDATLVWDRLPMTIAFTSIIAIFIIERIDERKGMISIVPLILAGIISIVYWRFFDDLRPYALVQFVPCIAMPLMAILLPPMYTHSTYWLWAAGFYLLAKVLEATDDVVYKWTHHIVSGHTLKHLFAAMVPIFLTFMLAKRSLEEDRQSLLKTWRISWTKIKEGDSSVESFTYSRVQVEEPQ

SEQ ID NO: 7068 - protein, 288 aa, Theobroma cacao
MRRRTVYAWGVAILSFVVLMIVTPAIPQSQEYHDFADQREFFGIPNTLNVVSNFPFLVIGVVGLVLCYYKNYFKLCLQGELWGWTCFFIGVAAVGVGSSYYHLQPNDARLVWDRLPMTIAFTSIIAIFIIERIDEQKGTVSIIPLLLAGVISIMYWRFFDDLRPYALVQFVPCIAIPLMAILLPPMYTHSTFWLWAAGFYLLAKVEEAMDKVIYKWTHHIVSGHTLKHLCAAMVPVFLTLMLAKRTIETERISLLKTWKVSWTKFKKNGSEVESCTCTYTSVQAEESH

SEQ ID NO: 7069 - protein, 206 aa, Glycine max
MVLSEEEMGRLYRIRKTVMQMLRDRGFLVGDFEINMSKHEFKSKYGEHMKREDLVINKSKKDNSGDQIYVFFPDEPKVGVKTMKTYTNRMNSENVYRAILVTQTNLTPFARTCISEISSKFHLEVFQEAELLVNIKEHELVPEHQVLTDAEKKTLLERYTVKETQLPRIQVTDPVARYYGLKRGQVVKIIRPSETAGRYVTYRFVV

SEQ ID NO: 7070 - protein, 206 aa, Vigna unguiculata
MVLPDEEISRLYRIRKTVMQMLRDRGYLVGDFEINMSKHEFKSKYGEHMKREDLVINKSKKDNSGDQIYVFFPEEAKVGVKTMKTYTNRMNSENVFRAILVTQTNLTPFARTCISEISSKFHLEVFQEAELLVNIKEHELVPEHQVLTDAEKKTLIERYTVKETQLPRIQVTDPVARYYGLKRGQVVKIIRPSETAGRYVTYRFVV

SEQ ID NO: 7071 - protein, 206 aa, Cajanus cajan
MVLLEEEIGRLYRIRKTVMQMLRDRGYLVGDFEINMSKHDFKSKYGENMKREDLVINKSKKDNSGDQIYVFFPEEVKVGVKTMKTYTNRMNSENVYRAILVLQTNLTPFARTCISEISSRFHLEVFQEAELLVNIKEHVLVPEHQVLTDAEKKTLLERYTVKETQLPRIQVTDPVARYYGLKRGQVVKIIRPSETAGRYVTYRFVV

SEQ ID NO: 7072 - protein, 207 aa, Phaseolus vulgaris
MVLTDEEISRLYRIRKTVMHMLRDRGYLVGDFEINMSKHEFKSSHGGENMKREDLDLNKSKKDNSSDQIYVFFPDEAKVGVKTMKTYTNRMNNDNVYRAILVTQTNLTPFARTCVSEISSKFHLEVFQEAELLVNIKEHELVPEHQVLTDAEKKTLIERYTVKETQLPRIQVTDPVARYYGLKRGQVVKIIRPSETAGRYVTYRFVV

SEQ ID NO: 7073 - protein, 206 aa, Glycyrrhiza uralensis
MVFSEEEISRLYRIRKTVMQMLRDRGYLVGDFEVNMPKHEFKSKYGEHMKREDLVINKTKKDNPSDQIYVFFPEEHKVGVKTMKTYTNRMNSENVYRAILVLQTNLTPFARTCVAEVSSKFHLEVFQEAELLVNIKEHVLVPEHQVLNDTEKKTLLERYTVKETQLPRIQVTDPVARYYGLKRGQVVKIIRPSETAGRYVTYRFVV

SEQ ID NO: 7074 - protein, 206 aa, Cicer arietinum
MVFPEEEITRLYRIRKTVMVMLRDRNYLVGDFEVNMSKHEFKEKYGENMKREDLVINKTKKDKPSDQIYVFFPEEVKVGVKTMKTYTNRMNSENVYRAILVCQTSLTPFARTCIAEVSSKFHLEVFQEAELLVNIKEHVLVPEHQVLTETEKKTLLERYTVKETQLPRIQVTDPVARYYGLKRGQVVKIIRPSETAGRYVTYRFVV

SEQ ID NO: 7075 - protein, 206 aa, Medicago truncatula
MVFSEEEITRLYRIRKTVMQMLKDRNYLVGDFELNMSKHDFKDKYGENMKREDLVINKTKKDKPSDQIYVFFPEEAKVGVKTMKTYTNRMNSENVYRAILVCQTSLTPFAKTCVSEIASKFHLEVFQEAELLVNIKEHVLVPEHQILNDTEKKTLLERYTVKETQLPRIQVTDPVARYYGLKRGQVVKIIRPSETAGRYVTYRFVV

SEQ ID NO: 7076 - protein, 206 aa, Cajanus cajan
MVVTEEEMGRLHRIRRTVMQMLRDRGYLVGDFEINMSKRDFVNKYGEHMKREDLVFNKSKKDNSGDQIYVFFPEEVKVGVKTMKTYTNRMNSENVFRAILVLQTSLTPFARTCISEIASKFHLEVFQEAELLVNIKDHCLVPEHQVLNQAEKKTLLQRYTVKETQLPRIQVTDPVARYYGLKRGQVVKIIRPSETAGRYVTYRFVV

SEQ ID NO: 7077 - protein, 206 aa, Trigonella foenum-graecum
MVFSEEEITRLYRIRKTVMQMLKDRNYLVGDFELNMAKHEFKDKYGENMKREDLVINKTKKDKPSDQIYVFFPEEAKVGVKTMKTYTNRMNSENVYRAILVCQTSLTPFAKTCVSEIASKFHLEVFQEAELLVNIKEHVLVPEHQILNDTEKKTLLERYTVKETQLPRIQVTDPVARYYGLKRGQVVKIIRPSETAGRYVTYRFVV

SEQ ID NO: 7078 - protein, 206 aa, Cicer arietinum
MGFPEEEITRLYRIRKTVMEMLRDRNYLVGDFEINMSKHQFKEKYGENMKREDLVINKTKKDKPSDQIYVFFPEEVKVGVKTMKTYINRMNSENVYRAILVCQTSLTPFARTSVAEISSKFHLEVFQEAELLVNIKDHVLVPEHQVLTDTEKKTLLERYTVKETQLPRIQVTDPVARYYGLKRGQVVKIIRPSETAGRYVTYRFVV

SEQ ID NO: 7079 - protein, 206 aa, Lotus japonicus
MALTEEDITKLHRIRKTVMQMLRDRNYLVGDFEINMSRHEFKTKYGDNMKREDLTINKTKKDGPSDQIYVFFPDEPKVGVKTMKTYTNRMNSENVFRAILVCQSNLTPFAKTCISEMSSKFQLEVFQEAELLVNIKEHVLVPEHQILNETEKKTLLERYTVKETQLPRIQITDPVARYYGLKRGQVVKIIRPSETAGRYITYRFVV

SEQ ID NO: 7080 - protein, 206 aa, Prunus persica
MVYPEEEITRLYRVRKTVMQMLKDRNYLVGDFEINMTREQFKSKYGENMKREDLTINKTKRSDSSDQIYVFFPEEPKVGVKTMKTYTNRMKSENVLRAVLVTQQNLTPFAKTCISEISSKFHLEVFQEAELLVNIKEHVLVPEHLVLTTEEKKTLLERYTVKETQLPRIQVTDPIAKYYGLKRGQVVKIIRPSETAGRYITYRYVI

SEQ ID NO: 7081 - protein, 809 aa, Malus domestica
MAENFAVPKYWTTLSLVLGFMMLSATGTSLLLPSLGDIESLLLNDTGSINSTSTDYGHIVYEFAAAVLNPTSPNDIVSLILSANNNSAPVSVAARGQGHSVRGQALTSGGVVINMTALIRNGSRIVVSESPSLGSYADVGGEQRWIDVLRATLERGLTPVSWTDYLYLSVGGTLSNAGISGQTFLYGPQINNVYELDVVTGKGELVTCSSKKVPELFYAVLGGLGQFGIITRARIPLAPAPKRAKWVRMMYSNFSAFSRDQEHLMAPNGFDYLEGFLLMKQGPLDLSFYPLLDQPRIAALINRYGIIYYIEAAKYYDDSTTKTVDKVVEKTIKGLSFVPEFLFEQDVSYIDFLDRVHTEEENLRSLGLWEIAHPWLNIFVPKSRISDIDSGVFRNILLKQNVPTAVSLIYPMNRKRWDGRMSAVIPDEDVFYVVGLLHASGFNDWQAFDEVNRQLLQFCTDAGIRVKQYLPHYKTREDWKNHFGRKWQSFQDMKVRVSPHVGEDQSLEPSRTPFGRQALPTMVALFTTSVGNPLPLSRNAILGTTRRQQLSFSRLFSVQIENPNHITNNLQRSCQFSCGDILYEHPLQLPTTNANFFCRTEAKMVLTEEEITRLYRVRKTVMQMLKDRNYLVGDFEINMSKEQFKDKYGENMKREDLIINKTKRTDTNDQIYVFFPDEPKVGVKTMKTYTNRMKSENVFRAILVTQQSLTPFAKTCISEISGKFHLEVFLEAELLVNIKEHVLVPEHRVLTNEEKKTLLERYTVKETQLPRIQVTDPIAKYYGLKRAQVVKIIRPSETAGRYVTYRYVI

SEQ ID NO: 7082 - protein, 206 aa, Prunus mume
MVYPEEEITRLYRVRKTVMQMLKDRNYLVGDFEINMTREQFKSKYGENMKREDLTINKTKRSDSSDQIYVFFPEEPKVGVKTMKTYTNRMKSENVLRAVLVTQQNLTPFAKTCISEISSKFHLEVFQEAELLVNIKEHVLVPEHLVLTTEEKKTLLERYTVKETQLPRIQVTDPIAKYYGLKRGQVVKIVRPSETAGRYITYRYVI

SEQ ID NO: 7083 - protein, 206 aa, Citrus clementina
MTLSDEEIKRLFRIRRTVMQMLRDRGYFVGDFEINMSKEQFIAKFGENMKREDLVINKALRNDSSDQIYVFFPDEQKVGVKTMKTYTNRMKSENVFRAILVVQQNLTPFARTCIQEISAKFHLEVFQEAELLVNIKEHVLVPEHQVLTNEEKKTLLKRYTVKETQLPRIQVTDPIARYYGLKRGQVVKIIRPSETAGRYVTYRYVV

SEQ ID NO: 7084 - protein, 206 aa, Euphorbia peplus
MTLSDEEIKRLFRIRKTVMQMLKDRGYLVGEFEINMSKEQFISKYGDNMKREDLVIHKSKRNDNSDQIYVFFPDEPKVGVKTMKTYTNRMKSENVFRAILAVQQNLTPFARTCIAEIASKFQLEVFQEAELLVNIKEHVLVPEHQVLTAEEKKTLLERYTVKETQLPRIQITDPVARYYGLKRGQVVKIIRPSETAGRYITYRYVV

SEQ ID NO: 7085 - protein, 206 aa, Quercus alba
MVLSEDETNRLFRIRKTVMQILKDRGYLVADFEVDMTKDQFRRKYGESMKREDLVINKTKRTDSSDQIYVFFPEEPKVGVKTMKTYTNRMKSENVFRAILVVQQNLTPFARTCISEISSKFHLEVFQEAELMVNIKEHVLVPEHQVLTTEEKKTLLERYTVKETQLPRIQVTDPIARYYGLKRGQVVKIIRPSETAGRYVTYRYVV

SEQ ID NO: 7086 - protein, 207 aa, Citrullus lanatus
MVLSEEEITRLFRIRKTVFQMLKDRGYFVGDFEIDMTREQFKHKYGESMKREDIVINKAKRNDSSDQIYVFFPEEPKVGVKTIKTYTQRMNSENVYRAILVVQQNLTPFARTCINEVISTKVHLEVFQEAELLVNIKEHVLVPEHQLLTNEEKKTLLERYTVKETQLPRIQVTDPVARYYGLKRGQVVKIIRPSETAGRYVTYRYVV

SEQ ID NO: 7087 - protein, 206 aa, Vitis vinifera
MSASEEEISRLFRIRKTVMQMLKDRGYFVGDFEINMTKHQFVSKFGENMKREDLVINKAKRTDSSDQIYVFFPEEQKVGVKTMKTYTNRMKSENVFRAILVVQQNLTPFARTCINEISTKFHLEVFQEAELLVNIKEHVLVPEHQVLTSEEKKTLLERYTVKETQLPRIQVSDPIARYFGLKRGQVVKIIRPSETAGRYITYRYVV

SEQ ID NO: 7088 - protein, 206 aa, Humulus lupulus
MVLPEDEITRLFRVRKTVMQMLKDRNYLVGDFEINMTREQFRNKYGESMKREDLTISKAKRNDSSDQIYVFFPEEPKVGVKTMKSYTNRMKSENVVRAMLVVQQNLTPFARTCISEISSKFHLEVFQEAELLINIKEHVLVPEHQVLTNEEKKTLLERYTVKETQLPRIQVTDPVARYYGLKRGQVVKIIRPSETAGRYITYRYVV

SEQ ID NO: 7089 - protein, 206 aa, Tripterygium wilfordii
MTLSEEEIKRLHRIRKTVMQMLLDRGYFVGDFEINMTKEQFITKYGENMKREDLMISKAKRSDSSDQIYVFFPEEAKVGVKTMKTYTNRMKSENVFRAILVVQQNLTSFARNCISEISSKFHLEVFQEAELLVNIKEHVLVPEHQVLNTEEKKTLLERYTVKETQLPRIQVTDPIARYYGLKRGQVVKIIRPSETAGRYVTYRYVV

SEQ ID NO: 7090 - protein, 206 aa, Fagus grandifolia
MAVSEDESNRLFRIRKTVMQMLRDRGYLVADFEVDMTKDQFRRKYGDTMKREDLVINKAKRNDSSDQIYVFFPEEPKVGVKTMKTYTNRMKSENVFRAVLVVQQNLTPFARTCISEISGKFHLEVFQEAELMVNIKEHVLVPEHQVLTNEEKKTLLERYTVKETQLPRIQVTDPVARYYGLKRGQVVKIIRPSETAGRYVTYRYVV

SEQ ID NO: 7091 - protein, 206 aa, Castanea mollissima
MVVSEDETNRLFRIRKTVMQMLKDRGYLVADFEVDMTKDQFRRKYGESMKREDLVINKTKRTDSSDQIYVFFPEEQKVGVKTMKTYTNRMKSENVFRAILVVQQNLTPFARTCISEISAKFHLEVFQEAELMVNIKEHVLVPEHQVLTTEEKKTLLERYTVKETQLPRIQVTDPIARYYGLKRGQVVKIIRPSETAGRYVTYRYVV

SEQ ID NO: 7092 - protein, 206 aa, Tropaeolum majus
MSMLDEDIKRLCRVRKTLMQMLKDRNYFVGDSEINMTKQQFISKYGENMKREDLVINKAKRNDSSDQIYVFFPEEPKVGVKTVKTYTNRMKSENVYRAILVVQVNLTPFARACVSEISSKFHLEVFQEAELLVNIKEHVLVPEHQVLTNEEKKTLLERYTVKETQLPRIQVTDPVARYYGLKRGQVVKIIRPSETAGRYITYRYVV

SEQ ID NO: 7093 - protein, 206 aa, Fagus grandifolia
MALSEDETNRLFRIRKTVMQMLRDRGYLVADFEVDMTKDQFRRKYGDSMKREDLVINKSKRNVTSDQIYVFFPEEPKVGVKTMKTYTNRMKSENVFRAILVVQQNLTPFARTCISEISGKFHLEVFQEAELMINIKEHVLVPEHQVLNNEEKKTLLERYTVKETQLPRIQVTDPIARYYGLKRGQVVKIIRPSETAGRYVTYRYVV

SEQ ID NO: 7094 - protein, 206 aa, Theobroma cacao
MVLSDDEIKRLFRIRKTVMQMLKDRGYFVGDFEITMTKAQFISKYGENMKREDLVINKTKRNDNSDQIYVFFPDEAKVGVKTMKTYTNRMKSENVFRAVLVVQQNLTPFARTCINEISSKFHLEVFQESELLVNVKEHSLVPEHQVLTNEEKKTLLQRYTVKETQLPRIQVSDPIARYYGLKRGQVVKIIRPSETAGRYVTYRYVV

SEQ ID NO: 7095 - protein, 206 aa, Unknown
  Sequence found in Organisms: Gossypium hirsutum, Gossypium raimondii
MVLSDDEIKRLFRIRKTVMQMLKDRGYFVGDFEINLSKQQFISKYGENMKREDLVINKTKRNDNSDQIYVFFPEEAKVGVKTMKTYTNRMKSENVFRAILVVQQNLTPFARTCINEISSKFHLEVFQEAELLVNVKEHALVPEHQVLTNEEKKTLLHRYTVKETQLPRIQVSDPIARYFGLKRGQVVKIIRPSETAGRYITYRYVV

SEQ ID NO: 7096 - protein, 206 aa, Heritiera littoralis
MALSDDEIKRLYRIRKTVLQMLKDRGYFVGDFEINMSKEQFISKYGENMKREDIIINKTKRNDNSDQIYVFFPDEAKVGVKTMKTYTNRMKSENVLRAILVVQQNLTPFARTCINEISTKFHLEVFQEAELLVNVKEHSLVPEHQVLTTEEKKTLLQRYTVKETQLPRIQVSDPIARYYGLKRGQVVKIIRPSETAGRYVTYRYVV

SEQ ID NO: 7097 - protein, 206 aa, Sesamum indicum
MVMSEEEITRLHRIRKTVMQMLKDRGYMVGAFEIDMPKHQFIQKYGENMKREDLVIQKGMGGNSSDQIYVFFPEEQKVGVKTMKTYTNRMKEEGVHRAILVVQQNLTPFARTCISEISTKFHLEVFQEAELLVNIKEHVLVPQHQVLTPEEKKTLLERYTVKETQLPRIQITDPIARYYGLKRGQVVKIIRPSETAGRYVTYRYVV

SEQ ID NO: 7098 - protein, 171 aa, Flaveria ramosissima
MDKRQFVHKYGEHMKREDLVICKSMKNDSSEQIYVFFPDEAKVGVKTIKNYINRMKSENVTRGILVVQQNLTPFARTCISEISTKFHLEVFQEAELLVNVKNHVLVPEHQVLTDEEKKTLLERYTVKETQLPHIQVSDPVARYYGLKRGQVVKIIRPSETAGRYVTYRYVV

SEQ ID NO: 7099 - protein, 206 aa, Manihot esculenta
MTLSEDEIKRLFRIRKTVMTMLKDRGYFVGDFEINMTREQFISKFGENMKREDLVINKTKRNDPSDQIYVFFPEEQKVGVKTMKTYTNRMKSENVFRAILVVQQNLTPFARTCISEIAAKFQLEVFQEAELLVNIKEHVLVPEHQVLTSEEKKTLLERYTVKETQLPRIQVSDPIARYYGLKRGQVVKIIRPSETAGRYITYRFVV

SEQ ID NO: 7100 - protein, 206 aa, Euonymus alatus
MTLSEDEIKRLHRIRRTVMQMLVDRGYFVGDFDINMTKEQFITKYGENMKREDLMISKAKRNDSSDQIYVFFPEEPKVGVKTMKTYTNRMKSENVFSGMLVVQQNLTPFARTCINEISSKFHLEVFQEAELLVNIKEHVLVPEHQVLTMEEKKTLLERYTVKETQLPRIQVTDPIARYYGLKRGQVVKIIRPSETAGRYVTYRYVV

SEQ ID NO: 7101 - protein, 206 aa, Populus trichocarpa
MTLTEEEIKRLLRIRKTVMQMLKDRGYFVGDFEIKMTREQFESKYGNNMKREDLVINKTKRNDSSDQIYVFFPEEAKVGVKTMKTYTNRMKSENVFRAILVVQQNLTPFARTCINEISTKFHLEVFQEAELLVNIKEHVLVPEHQVLSNEEKKTLLERYTVKETQLPRIQITDPIARYYGLKRGQVVKIIRPSETAGRYVTYRYVI

SEQ ID NO: 7102 - protein, 205 aa, Ricinus communis
MTLSEDEIKRLFRIRRTVMQMLKDRTYLVTDSEINITKHQFTSKYGDNMKREDLVIHKSKRDGSDSIYVFFPEEQKVGVKTMKTYTNRMKSENVFRAILVVQQSLTPFARTCIAEIASKFHLEVFQESELLVNIKEHVLVPEHQVLTNEEKKTLLERYTVKETQLPRIQISDPIARYYGLKRGQVVKIIRPSETAGRYVTYRYVV

SEQ ID NO: 7103 - protein, 206 aa, Olea europaea
MVLSDEEITRLFRIRKTVMQMLRDRGYIVSDFEIDMSKHQFLSKYGENTKREDLVIIKDLRSNPSEKIYVFFPEEAKVGVKTMKTYTNRMKDDDVHRAILVVQQNLTPFARTCISEISTKFHLEVFQEAELLVNIKEHVLVPEHQLLTPEEKKTLLERYTVKETQLPRIQVTDPIARYYGLKRGHVVKIIRPSETAGRYVTYRYVV

SEQ ID NO: 7104 - protein, 203 aa, Cannabis sativa
WEFTITRLFRVRKTVMQMLKDRNYLVGDFEINMTREQFRNKYGESMKREDLTISKAKRNDSSDQIYVFFPEEPKVGVKTMKSYTNRMKSENVVRAMLVVQQNLTPFARTCISEISSKFHLEVFQEAELLINIKEHVLVPEHQVLTNEEKKTLLERYTVKETQLPRIQVTDPVARYYGLKRGQVVKIIRPSETAGRYITYRYVV

SEQ ID NO: 7105 - protein, 206 aa, Gossypium hirsutum
MVLSDDEIRRLFRIRKTVLQLLKDRDYFVGDFEINMSREQFISKFGENMKREDLIINKAKRNDSSDQIYVFFPEEPKVGVKTMKTYTNRMKSENVFRAILVVQQNLTPFARTCINEISSKFHLEVFQETELLVNVKEHSLVPEHQVLTTEEKKTLLQRYTVKETQLPRIQVSDPIARYYGLKRGQVVKIIRPSETAGRYITYRYVV

SEQ ID NO: 7106 - protein, 206 aa, Tabernaemontana elegans
MTLSDEEITRLFRIRKTVLQMLKDRGYFVADKEIDMQKRDFLQKYGENMKREDLVINKSKRSDSSDQIYVFFPEEQKVGVKTMKTYTNRMKSENVFRAILVVQQNLTPFARTCVSEISTKFHLEVFQEAELLVNIKNHVLVPEHQLLTSDEKKTLLERYTVKETQLPRIQVTDPVARYYGLKRGQVVRISRPSETAGRYITYRFVV

SEQ ID NO: 7107 - protein, 188 aa, Cannabis sativa
MQMLKDRNYLVGDFEINMTREQFRNKYGESMKREDLTISKAKRNDSSDQIYVFFPEEPKVGVKTMKSYTNRMKSENVVRAMLVVQQNLTPFARTCISEISSKFHLEVFQEAELLINIKEHVLVPEHQVLTNEEKKTLLERYTVKETQLPRIQVTDPVARYYGLKRGQVVKIIRPSETAGRYITYRYVV

SEQ ID NO: 7108 - protein, 220 aa, Eucalyptus grandis
MPPHPPHPPPPIRDTALSEEEITRLHRIQRTVLQMLRDRGYLVTDGELNMTRFQFIEKYGENMKREDLVINKHKRNESSDQIYVFFPEEAKVGVKTMKTYTTRMNSENVFRAILAVQQNLTPFARTCISEISTKFHLEVFQEAELLVNIKEHVLVPEHQVLANEEKKTLLQRYTVKETQLPRIQVTDPVARYYGLKRGQVVKIIRPSETAGRYVTYRYVV

SEQ ID NO: 7109 - protein, 207 aa, Cucumis melo
MVLSEEEITRLFRIRKTVFQMLRDRGYFVGDFEIDMTREQFKQKYGENMKREDIVINKSKRNDSSDQIYVFFPEEAKVGIKPLKTYTTRMKSENVFRAILVVQQNLTPFARACMSEATSKSFHLEVFQEAELLVNIKDHVLVPEHQLLTNEEKKTLLERYTVKETQLPRIQVTDPVARYYGLKRGQVVKIIRPSETAGRYVTYRYVV

SEQ ID NO: 7110 - protein, 208 aa, Primula obconica
MSGGPSEEELNRLFRIRKTVMVMLRDRDYVVGDYEIDMTKHQFSQKYGDYLKREDLVISKAKRNDSSDQIYVFFPEEPKVGVKTMKTYTNRMKSENVFRAILVVQQNLTPFARTCINEISSKFHLEVFQEAELLVNIKEHVLVPEHQLLTNEEKKTLLERYTVKETQLPRIQMTDPVARYYGLKRGQVVKIIRPSETAGRYVTYRYVV

SEQ ID NO: 7111 - protein, 206 aa, Olea europaea
MVLSDEEIARLFRIRKTVMQMLRDRGYTVGDFEIDMSKHQFLSKYGENMKREDLIIIKELRSNPSEKIYVFFPEEAKVGVKTMKTYTNRMKDDDVHRAILVVQHNLTPFARTCISEISTKFHLEVFQEAELLVNIKEHVLVPEHQLLTPEEKKSLLERYTVKETQLPRIQVTDPISRYYGLKRGHVVKIIRPSETAGRYVTYRYVV

SEQ ID NO: 7112 - protein, 206 aa, Antirrhinum majus
MVLSEEEVARLCRIRKTVMEMLRDRGYLVGDFEIEMSKHQFLTKYGDNAKREDLVISKGLRINDSEKIYVFFPEEPKVGVKTMKTYTNRMKEDGVHRAILVVQQNLTPFARTCISEISTKFHLEVFQEAELLINIKEHVLVPEHQLLTPEEKKTLLERYTVKETQLPRVQITDPVARYYGLKRGQVVKIIRPSETAGRYVTYRYVV

SEQ ID NO: 7113 - protein, 206 aa, Vaccinium corymbosum
MSTSDEEITKLYRIRKTVMRMLCDRGYLVGDFDLEMTKQQFIQKYGENMKREDLVISKAKRSDSSDQIYVFFPEEPKVGVKTMKNYTNRMKSENVFRAILVVQQNLTPFARACISEISTKFHLEVFQEPELLVNIKEHVLVPEHQLLTNEEKKTLLDRYTVKETQLPRIQVTDPVARYYGLKRGQVVKIIRPSETAGRYVTYRYVV

SEQ ID NO: 7114 - protein, 206 aa, Actinidia deliciosa
MSTSEEEITRLHRIRHTVMQMLKDRGYLVGDFELDMTKQQFIQKFGENMKREDLIINKTKRNDSSDQIYVFFPEEQKVGVKTMKTYTNRMKSENVFRAILVVQQSLTPFAKACISEISTKFHLEVFQEPELLVNIKEHVLVPEHQLLSSEEKKTLLERYTVKETQLPRIQVTDPVARYYGLKRGQVVKIIRPSETAGRYVTYRFVV

SEQ ID NO: 7115 - protein, 208 aa, Flaveria ramosissima
MSTSLSEEEIKRLFRIRKTVMEMLKDRNYLVGDFELEMDKRQFVQKYGEHMKREDLVICKSMKNDSSEQIYVFFPDEAKVGVKTIKNYINRMKSENVTRGILVVQQNLTPFARTCISEISTKFHLEVFQEAELLVNVKNHVLVPEHQVLTNEEKKTLLERYTVKETQLPRIQVSDPVARYYGLKRGQVVKIIRSSETAGRYVTYRYVV

SEQ ID NO: 7116 - protein, 208 aa, Helianthus annuus
MSTSLSEEEVKRLFRIRKTVMEMLKDRNYLVGDFELEMDRRQFVSKYGEHMKREDLVISKSMKNDSSEQIYVFFPDEAKVGVKTIKNYINRMKSENVTRGILVVQQNLTPFARTCISEISTKFHLEVFQEAELLVNVKNHVLVPEHQVLTNEEKKTLLERYTVKETQLPRIQVSDPVARYYGLKRGQVVKIIRPSETAGRYVTYRYVV

SEQ ID NO: 7117 - protein, 207 aa, Cucumis sativus
MVLSEEEITRLFRIRKTVFQMLRDRGYFVGDFEIDMTREQFKQKYGENMKREDIVINKSKRNDSSDQIYVFFPEEAKVGIKPLKTYTTRMKSENVFRAILVVQQNLTPFARACMSEATSKSFHLEVFQEAELLVNIKDHVLVPEHQLLNNEEKKTLLERYTVKETQLPRIQVTDPVARYYGLKRGQVVKIIRPSETAGRYVTYRYVV

SEQ ID NO: 7118 - protein, 206 aa, Prunus mume
MVLPEEEITRLYRVRRTVMQMLRDRKYLVGDFEINMTREQFKAKYGENMKREDLTINKTKRNDSTDQLYVFFPEEPKVGVKTIKTYTNRMKSENVSRAILVTQQNMTPMARTCISEISSKFHMEVFQEPELMVNVTEHVLVPEHQLLTNEEKKTLLERYTVKETQLPRIQLTDPVAKYYGLKRGQVMKIIRPSETAGRYITYRYVV

SEQ ID NO: 7119 - protein, 208 aa, Unknown
  Sequence found in Organisms: Centaurea maculosa, Cirsium arvense
MSAALTEEEIKRLFRIRKTVMEMLKDRNYLVGDFELEMDKRQFIHKYGDNMKREDLVISKSLKNDSSEQIYVFFPDEAKVGVKTIKNYINRMKSENVTRAILVVQQNLTPFARTCISEISTKFHLEVFQEAELLVNVKNHVLVPEHQILSHEEKKTLLERYTVKETQLPRIQVTDPVARYYGLKRGQVVKIIRPSETAGRYVTYRYVV

SEQ ID NO: 7120 - protein, 208 aa, Cirsium arvense
MSTSLTEEEIKRLFRIRKTVMEMLKDRNYLVGDFELEMDRRQFINKYGDNMKREDLVISKSLKNDSSEQIYVFFPDEAKVGVKTIKNYINRMKSENVTRAILVVQQNLTPFARTCISEISTKFHLEVFQEAELLVNVKNHVLVPEHQVLANEEKKTLLERYTVKETQLPRIQVTDPVARYYGLKRGQVVKIIRPSETAGRYVTYRYVV

SEQ ID NO: 7121 - protein, 171 aa, Fraxinus spp
MSKHQFLSKYGENMKREDLVILKDLRSNPSEKIYVFFPEEAKVGVKTMKTYTNRMKDDDVHRAILVVQQNLTPFARTCISEISTKFHLEVFQEAELLVNIKEHVLVPEHQLLTPEEKKTLLERYTVKETQLPRIQVTDPIARYYGLKRGHVVKIIRPSETAGRYVTYRYVV

SEQ ID NO: 7122 - protein, 208 aa, Ambrosia trifida
MSTSLSEDEIKRLFRIRKTVMEMLKDRNYLVGDFELEMDRRQFVQKYGEHMKREDLVISKSMKNDSSEQIYVFFPDEAKVGVKTIKNYINRMKSENVTRGILVVQQNLTPFARTCISEISTKFHLEVFQEAELLVNVKNHVLVPEHQVLTNEEKKTLLERYTVKETQLPRIQVSDPVARYYGLKRGQVVKIIRPSETAGRYVTYRYVV

SEQ ID NO: 7123 - protein, 208 aa, Flaveria ramosissima
MSTSLSEEEIKRLFRIRKTVMEMLKDRNYLVGDFELEMDKRQFIQKYGEHMKREDLVICKSMKNDSSEQIYVFFPDEAKVGVKTIKNYINRMKSENVSRGILVVQQNLTPFARTCISEISTKFHLEVFQEAELLVNVKNHVLVPEHQVLTNEEKKTLLERYTVKETQLPRIQVSDPVARYYGLNGGQVVKIIRPSETAGRYVTYRYVV

SEQ ID NO: 7124 - protein, 207 aa, Centaurea maculosa
STALTEEEIKRLFRIRKTVMEMLKDRNYLVGDFELEMDKRQFIQKYGDNMKREDLVISKSLKNDSSEQIYVFFPDEAKVGVKTIKNYINRMKSENVTRAILVVQQNLTPFARTCISEISTKFHLEVFQEAELLVNVKNHVLVPEHQILSNEEKRTLLERYTVKETQLPRIQVTDPVARYYGLKRGQVVKIIRPSETAGRYVTYRYVV

SEQ ID NO: 7125 - protein, 206 aa, Unknown
  Sequence found in Organisms: Brassica napus, Brassica juncea, Brassica oleracea, Brassica rapa, Raphanus sativus
MGLTEEEIKRLYRIQKTLMQMLKDRGYFIADSEITMSLSQFVRKYGDNMKREDLVTLKAKRNDSSDQLYIFFPDEAKVGVKTMKVYTNRMKSENVYRAILVVQQNLTPFARTCISEISSKFHLEVFQEAEMLVNIKEHVLVPEHQVLTTEEKKTLLERYTVKETQLPRIQVTDPIARYFGLKRGQVVKIIRPSETAGRYVTYRYVV

SEQ ID NO: 7126 - protein, 208 aa, Centaurea maculosa
MSTALTEEEIKRLFRIRKTVMEMLKDRNYLVGDFELEMDKRQFIQKYGDNMKREDLVISKSLKNDSSEQIYVFFPDEAKVGVKTIKNYINRMKSENVTRAILVVQQNLTPFARTCISEISTKFHLEVFQEAELLVNVKNHVLVPEHQILSNEEKRTLLERYTVKETQLPRIQVTDPVARYYGLKRGQVVKIIRPSETAGRYVTYRYVV

SEQ ID NO: 7127 - protein, 208 aa, Lactuca sativa
MSTALTEEDIKRLYRIRKTVMEMLKDRNYLVGDFELEMDRRQFIQKYGDNMKREDLVISKSLKNDSSEQIYVFFPDEAKVGVKTIKNYINRMKSENVTRGILVVQQNLTPFARTCISEISAKFHLEVFQEAELLVNVKNHVLVPEHQVLANEEKKTLLERYTVKETQLPRIQVTDPVARYYGLKRGQVVKIIRPSETAGRYVTYRYVV

SEQ ID NO: 7128 - protein, 206 aa, Mimulus guttatus
MVLSDEEITRLVRVRKNVMQMLKDRGYMVGDFEIDMTKYQFLQKYGENMKREDLVINKGLRNNSSDQIYIFFPEEPKVGVKTMKTYTNRMKEEGVHRAVLIVQQNLTPFARTCISEISTKFHLEVFQEAEMLINIKEHVLVPEHQVLTPEEKKTLLERYTVKETQLPRIQITDPIARYYGLKRGHVVKIIRPSETAGRYVTYRYVV

SEQ ID NO: 7129 - protein, 206 aa, Orobanche aegyptiaca
MVMSEEEITRLHRIRKTVMEILRDRGYMVGDFEIEMPRHQFLQKHGENMKREDLIINKGLRSNNSDQIYVFFPEEPKVGVKTVKTYTNRMKEEGVHRAILVVQQNLTPFARACISEISSKFHLEVFQEAELLINIKEHVLIPEHQLLTPEEKKTLLERYTVKETQLPRIQITDPIARYYGLKRGQVVKIIRPSETAGRYVTYRYVV

SEQ ID NO: 7130 - protein, 742 aa, Phaseolus vulgaris
MKMLPTSAAGEPSHGGRTVVVGVKMDSHSTELLTWALFKVAQPCDVVLALHVLGNDEIVNRDGKSSLFSLVKAFDSVLAVYEGFCNLKQVDLKFKICRGSSVRKILVREANAYSATHIIVGSPQGLHRIRPCISVARYCARKLPKDCWVLAVHNGKIVFKRDGSPATLADMKGVDQNPTTGVLCSIHRTLGKTSKVLDDDGTGIQEKGSGQFSDHSLAKAFLDSKEFIEKKSCSICSSNPALFGLCCNHLEEESCGDACHENPLAIVSVQTNDSASKPGWPLLHRTIISDRKCSERSPFRQISVVQWAMQLPSRDLSYDAHLVQKTNYCGPNKDEFLALDSKSGALVPVDAEIGTAPLPDHNTRSIPKELEGLHEKYSSSCRLFKYQELVLATSNFLPENLIGKGGSSQVYRGCLPDGKELAVKILKPSDDVLKEFVLEIEIITTLHHTNIISLLGFCFEDGNLLLVYDFLSRGSLEENIHGNKKNPLVFGWTERYKVAMGVAEALDYLHNNEGQSVIHRDVKSSNVLLSEDFEPQLSDFGLAKWASTSSSHIICTDVAGTFGYMAPEYFMYGKVNDKIDVYAFGVVLLELLSGRKPISSDYPKGQESLVMWANPILNSGKVLQLLDPSLGDNYDPEEMERMVLAATLCIRRAPRARPPMTLISKLLGGDSEVVNRARVEVHAMEAAEMLDDEACSPSNLQSHLNLALRDVEDDSLSICSVEQNVSLEDYLRGRWSRSSSFD

SEQ ID NO: 7131 - protein, 742 aa, Cajanus cajan
MKMQQFATAGEPSHGGSDARTVVVGVKMDSHSRELLTWALFKLAQPGDVVLALHVLGNDEIVNREGKSSLFSLVKAFESVLAVYEGFCDLKQVDLKLKICRGSSVKKILVREADACSATHILVGTPHGLSRIRPCISVAKYCAKKLPKDCWVLAVNNGKVVFKRDGSPATRADIKGLNHQDHKNGLLGTLSKSSQVLDVDGTVMNGKGGGQFSDHSLAKAFLDSKEFKGKKGCFICASTPALFDSTCKNSEEESCGEVEEKNPLAIVPVQTNGAASKAGWPLLHRKIVSDGKCPERSVLRQISVVQWAMQLPSRNISYTAHHDHKTYHFDRDKDRFSGLDSNCGALVPVNAEIGTVSLPEHNSRSIPKELVGLHEKYSSTCTLFKYQELVSATSNFLPENLIGKGGSSEVYRGCLPDGKQLAVKILKPSEEVLKEFVLEIEIITTLHHKNIISLLGFCFEDGNLLLVYDFLSRGSLEENLYGNKKIPLVFGWTERYKVAMGVAEALEYLHDNEGQSVIHRDVKSSNVLLSEDFEPQLSDFGLAKWASTSSSHIICTDVAGTFGYMAPEYFMYGKVTEKIDVYAFGVVLLELLSGRKPISGDYPKGQESLVMWASPILNSGKASQLLDPSLGDNYDHEEMERVVLAATLCIRRAPRARPQISLISKLLGGDADVIKWARLEVNATEAPEMLDDETCPPSILQSHLNLALLDVEDDLLSMCSVDQHVSLEDYLRGRWSRSSSFD

SEQ ID NO: 7132 - protein, 1324 aa, Glycine max
MGTPDKKVSDFVDVVRSWIPRRAEPPNVSRDFWMPDQSCRVCYECDSQFTIFNRRHHCRICGRVFCAKCTANSVPVPSDEPNTGREDLERIRVCNYCFKQWEQVATVDNNGSADLSATPCLSPSPSTTSLVSTKSSCTCHSSSSTAGSVPYTTGPYQRVPYSPHQSSQMNQITDEQENLNSGRSANPSESVGNVTSNQFGYCFSRSDDEDDDYGAYHSDTESRHYSHAHDYDDPVNIHGVDHVYGPHQMHPDEDNIQEKSSSCLTQSQNLDLEGVAGIQAPGKEDDEPDHADGCETSPYHEESNYAEPVDFENNGQLWIPPEPEDEEDDREAVLFDDDEDEGTTGGGEWGYLRSSTSFGSGECRSRDKTTEDHRKAMKTVVEGHFRALVAQLLQVENLTTCDEDGKETWLDIITALSWEAATLLKPDTSRGGGMDPGGYVKVKCIACGHRNESMVVKGVVCKKNVAHRRMTAKIDKPRFLILGGALEYQRVSNQLSSVDTLLQQEMDHLKMAVARIDAHHPNVLLVEKSVSRYAQEYLLAKDISLVLNIKKPLLERIARCTGAQIVPSIDHLTSQKLGYCETFHVDKFFEEHGSAGQGGKKSTKTLMFFEGCPKPLGCTILLKGANGDELKKVKHVIQYGIFAAYHLALETSFLADEGASPLEFPLKSPITVALPDKPSSTVRSISTIPGFSVLTARESQGAKPFKEVPKSNDIYKTERTPSSCSESTERLLVGDSIHMHEVSGGITQLALDMPSSNCNSFVSNTSSKENDKKCPKEFFQYRPDERRETMLNNGLISNSFGTFESSQQDGNSHLRAAALFANQGANPEPPNVKHDTNNFNNNNDHDDMIHSKEDFPPSTSDHQSILVFLSTRCVWKGTVCERSHLVRIKYYGSSDKPLGRFLRDQLLDPSYTCCSCELPSEAHVHCYTHRQGSLTICVKKLEFALPGEREGKIWMWHRCLKCPRIHGFPPATRRIVMSDAAWGLSFGKFLELSFSNHAAASRVASCGHSLHRDCLRFYGFGKMVACFRYASIHLHSVYLPPSKLEFNYDSQDWLQKEANELHNKAEILFSEVCNTLHQISEKVSGPVLQEGGNRVSDFRNLIAELKGMLQYEKEEFEDSLQKLLHKEGKAGQPVIDILELNKLRRHILIHSYVWDQRLIYASNLSKIILQENLKSLNHREKLLGSREKVVEADVATRPARGHSSCDSFLLETKPDGNLNLENTSHLSHPVVKSEDKGKDTNHDKVDLSLSGGANINDKSDSVEFGGAVRKALSEGESLQLWLIYLIPLMLHGQVKVILQIHHSKKMVVYLPMQQLWLFIHLWQI

SEQ ID NO: 7133 - protein, 1782 aa, Glycine max
MGTPDKKVSDFVDVVRSWIPRRAEPPNVSRDFWMPDQSCRVCYECDSQFTIFNRRHHCRICGRVFCAKCTANSVPVPSDEPNTGREDLERIRVCNYCFKQWEQVATVDNNGSADLSATPCLSPSPSTTSLVSTKSSCTCHSSSSTAGSVPYTTGPYQHEQENLNSGRSANPSESVGNVTSNQFGYCFSRYSFFFVYFFRLLNVIVFPFPFLMMVNSAVVVKLSVFLFLLLFYVYSSEPGVMMRMMIMVLIILIQNQGIILMPMTTTIQLTFMGLTISSCLTQSQNLDLEEDDEPDHADGCETSPYHEESNYAEPVDFENNGQLWIPPEPEDEEDDREAVLFDDDEDEGTTGGGEWGYLRSSTSFGSGECRSRDKTTEDHRKAMKTVVEGHFRALVAQLLQVENLTTCDEDGKETWLDIITALSWEAATLLKPDTSRGGGMDPGGYVKVKCIACGHRNESMVVKGVVCKKNVAHRRMTAKIDKPRFLILGGALEYQRVSNQLSSVDTLLQQEMDHLKMAVARIDAHHPNVLLVEKSVSRYAQEYLLAKDISLVLNIKKPLLERIARCTGAQIVPSIDHLTSQKLGYCETFHVDKFFEEHGSAGQGGKKSTKTLMFFEGCPKPLGCTILLKGANGDELKKVKHVIQYGIFAAYHLALETSFLADEGASPLEFPLKSPITVALPDKPSSTVRSISTIPGFSVLTARESQGAKPFKEVPKSNDIYKTERTPSSCSESTERLLVGDSIHMHEVSGGITQLALDMPSSNCNSFVSNTSSKENDKKCPKEFFQYRPDERRETMLNNGLISNSFGTFESSQQDGNSHLRAAALFANQGANPEPPNVKHDTNNFNNNNDHDDMIHSKEDFPPSTSDHQSILVFLSTRCVWKGTVCERSHLVRIKYYGSSDKPLGRFLRDQLLDPSYTCCSCELPSEAHVHCYTHRQGSLTICVKKLEFALPGEREGKIWMWHRCLKCPRIHGFPPATRRIVMSDAAWGLSFGKFLELSFSNHAAASRVASCGHSLHRDCLRFYGFGKMVACFRYASIHLHSVYLPPSKLEFNYDSQDWLQKEANELHNKAEILFSEVCNTLHQISEKVSGPVLQEGGNRVSDFRNLIAELKGMLQYEKEEFEDSLQKLLHKEGKAGQPVIDILELNKLRRHILIHSYVWDQRLIYASNLSKIILQENLKSLNHREKLLGSREKVVEADVATRPARGHSSCDSFLLETKPDGNLNLENTSHLSHPVVKSEDKGGISPVVANLSDTLDAAWTGEGHPTNSSLKENGCLPPDAAAVAVHSPVANIVTSKSNSNIYTANIGGVEAGCTNYSKLLSKGLDTTWKGIPFANVFGSFNKTSSFNTEKLVEYNPVHILSFRELERQTGARLLLPAGTNDTIVPVYDDEPTSVIAYVLVSMDYHMQMLEYDRPKDSGDSSISLPLFDSTSLLSLNSFDETITNTYRSLGSFEENVLSTSGSRSLPAGDPFSYTKDLHARVSFTDDSSLGKVKYTVTCYYAKRFEALRRTCCPSELDFVRSLSRCKKWGAQGGKSNVFFAKTLDDRFIIKQVTKTELESFTKFAPAYFKYLSESISTGSPTCLAKILGIYQVTSKHLKGGKETKMDVLVMENLLYRRNIRRLYDLKGSSRSRYNPDTSGSNKVLLDQNLIEAMPTSPIFVGNKAKRLLERAVWNDTAFLASIYVMDYSLLVGVDEEKHELVLGIIDFMRQYTWDKHLETWVKTSGILGGPKNTSPTVISPQQYKKRFRKAMSLYFLMVPDQWSPPELHPSGSQSDICDENA

SEQ ID NO: 7134 - protein, 1785 aa, Phaseolus vulgaris
MDTPDKKRSDFVDVVRSWIPRRTEPPNVSRDFWMPDQSCRVCYECDSQFTIFNRRHHCRICGRVFCAKCTANSVPAPSDEPNTVREEWERIRVCNYCFKQWEGLATIDNNGRADPSSTPCLSPSPSTTSLVSTKSSCTCHSSSSTAGSVPYTTGPYQRVPYSPRQSSQMNQIADEQDNLNSGRSSNPSEAVGNLTSNQFGYCFNRSDDEDDDYGVYHSDTESRHYSHVHDFEDPVNIHGVEHVYGPHQMHPDEASIHEKSLSCLTPPQNLDLEGVDGIQAPGKEADEHDHADGCETSPYHEESNNTDPVDFESNGLLWLPPEPEDEEDDREAVLFDDDEDEGTTGGGEWGYLRSSTSFGSGECRSRDKTSEDHRKAMKTVVEGHFRALVTQLLQVENLTICDEDGKESWLDIITALSWEAATILKPDMSRGGGMDPGGYVKVKCIACGHRNESMVVKGVVCKKNVAHRRMTSKIDKPRFLILGGALEYQRVSNQLSSVDTLLQQEMDHLKMAVARIDAHHPNVLLVEKSVSRYAQDYLLAKDISLVLNIKKPLLERIARCTGAQIVPSIDHLTSQKLGYCETFHVDKFFEEHGSAGQGGKKSTKTLMFFEGCPRPLGCTILLKGANGDELKKVKHVIQYGVFAAYHLALETSFLADEGASPLEFPLKSPITVALPDKPSSIVRSISTIPGFSVLSARESQGAKPFEIPKSDDIHKTERTPSSCSESTERSLVGDSINMHEVPGVAIQSAQDMPSSLCKSFLSNTASKEDDSFGTFDSSQQDGNSYLRAAELYANQGPSFGAPYVKHDTNNSNNNNDHEDMVHSNEDFPPSTSDHQSILVFLSTRCAWKGTVCERSHLVRIKYYGSSDKPLGRFLRDQLLDQSYTCCSCESPPEAHVHCYTHRQGSLTISVKKLSDFDLPGEREGKIWMWHRCLKCPRVNGFPPATRRVVMSDAAWGLSFGKFLELSFSNHAAASRVASCGHSLHRDCLRFYGFGKMVACFRYASIHLHSVYLPPPKLEFFNYDRQDWLLKEAYELHDKAELLFGEVCTVLHQNSEKVSGLVLQEGGQRVSDFRNLIVELKEMLQYEKEEFEDSLRKMLHREAKAEQPVIDILELNKLRRHILIHSYVWDQRLIYAFNLCKIILQENSRILNHREKLLGPREKLVEADIATRPARGYSSSDSFLLETKPDGNLNLENTSHLSHPDEVIKCEDKVKDTNHDKVDLSLSGCANINDRSDSVEFGGSVRRALSEGESSVVVNLSDTLDAAWTGESHPTISSLKENGCQSPDMSVHSPVANTVSSKSNSANYNADIGGIEAGCTNYSKILSKGLDAKWKAVPFANFFGSFNKTSSFNIQKLVEYNPVHILSFREVERQTGARLLLPAGTSDTIVPVYDDEPTSVIAYVLVSVDYHMQMSEFDRPKDSGDSSISLPLFDSSILSLNSFDETITNTYRSLGSFDESMLSTSGSRSLPAGDPPSYTKDFHARVSFTDDSSLGKVKYTVTCYYAKRFEALRRTCCPSELDFVRSLSRCKKWGAQGGKSNVFFAKTLDDRFIIKQVTKTELESFTKFAPAYFKYLSESISTGSPTCLAKILGIYQVTSKHLKGGRETKMDVLVMENLLYRRNIRRLYDLKGSSRSRYNPDTSGSNKVLLDQNLIEAMPTSPIFVGNKAKRLLERAVWNDTAFLASIYVMDYSLLVGVDEEKHELVLGIIDFMRQYTWDKHLETWVKTSGILGGDKNTSPTVISPQQYKKRFRKAMSLYFLMVPDQWSPPELHPSGSQSDIYDDNA

SEQ ID NO: 7135 - protein, 1801 aa, Lotus japonicus
MGTPEKKVSDFIDVVRSWIPRRADSPNVSRDFWMPDQSCRVCYECDSQFTIFNRRHHCRICGRVFCAKCTANSIPVPLDGTSTGREDWERIRVCNFCFNQWQQAVATVDNGTPSATPCLSPSPSTTSLVSTKSSCTCHSSSTAGSVPYSTGPYQRVPYSPHQSSEMNTVTDEQENLNSGSTNPSADVENLSSNQFSYCFNRSDDEDDDYDVDTDTESRHFSHANHYDGPVNIHEIDRVYGPHINHSDGDNFQETSSSCLTATPNLDQEGVDGVQAPGKEADEHDHDGCETSPYHEESSNAEPVDFENNGLLWLPPEPEDEEDDREAAPFDDEDEDEGSTGEWGYLRSSNSFGSGESRNRDKSIEDSRKAMKNVVEGHFRALIAQLLQSEELSICDEENKERWLDIITTLSWEAATLLKPDMSGAGGMDPGGYVKVKCIACGHPKESVVVKGIVCKKNVAHRRMTSKIDKPRFLILGGALEYQRVSNQLSSVDTLLQQEMDHLKMAVARIAAHHPNVLLVEKSVSRYAQEYLLAKDISLVLNIKRPLLERIARCTGAQIVPSIDHLTSQKQGYCETFHVDKFFEEHGTAGQGGKKSTKTLMFFEGCPKPLGCTILLKGANGDELKKLKHVVQYGIFAAYHLALETSFLADEGASPLEFPLKSPITVALPDNRSSIVRSISTIPGFTVTTPREHQGSETIKEVPKSNDRHNTERTPSRCSGSFERSQVGDSIHMHEVFGEVTRPVQDMTSTHCNSFLADTDSKEDVKKCPKEFFQYRQDESGEMMLNNDHISDSFGTFEPSVQEGNNHIKAVALASHQGANPEPPIVKIDNYNNDDDDMLHSKEDFPASTSDHQSILVFLSTRCVWKGTVCERSHLVRIKYYATSDKPLGRFLRDRLFDQSYTCCSCEMPPEAHVQCYTHRQGSLTIAVKKLPEFPLPGERDGKIWMWHRCLKCPRVNGFPPATRRIVMSDAAWGLSFGKFLELSFSNHAAASRVASCGHSLHRDCLRFYGFGKMVACFSYASIHLHSVFLPPPKLEFNHDTQDWLQKEALEVHDKAEILFSEVCNGLHQISEKISGPMLQEGGNIVAKFKLLVAELKGILQKEKEEFEDLLQKLLHKEPKAGQSMVDILELNKLRRHILTHSYVWDRRLIYASNLSKTTLQEDSRNSYLKEKSISSKEKVAEKDAASRFTRGHSSCDSLHLETKPDGNLNLENTSRLNQSGEVIKGEDKGKDKSHDKVDLSLSGGANVNDKSNSLEFGGAGRRASPEGGSPTVANLSDTLDAAWTGESHPTSLSFKENGCLPPDSAVVTVHSPVANIVSTTSNSDNYTADIGGTETGHIKLLPKGLDARWSGMPFANLYSFNKTSTVNTQKLVEYNPVHIPSFRELERQIGARLLLPAGINDTIVPVYDDEPTSVIAHVLVSIDYHIQMSESDRPKDSLDSSVSLPLFDSTSLLSLGSFDETLTNTYRSFGSSDESMLSTSGSRSSLAGDPLLYTKDFHARVSFADDSSLGKVKYTVTCYYAKRFEALRKICCPSELDFVRSLSRCKKWGAQGGKSNVFFAKTLDDRFIIKQVTKTELESFIKFAQAYFKYLSESISTGSPTCLAKILGIYQVTSKHVKGGKETKMDVLVMENLLYRRNIRRLYDLKGSSRSRYNPDTSGSNKVLLDQNLIEAMPTSPIFVGNKAKRLLERAVWNDTAFLASIYVMDYSLLVGVDEEKHELVLGIIDFMRQYTWDKHLESWVKTTGILGGPKNASPTVISPQQYKKRFRKAMSLYFLMVPDQWSPPGLNPTGSQSDHCDENS

SEQ ID NO: 7136 - protein, 311 aa, Cajanus cajan
MSEPPKARVVICVGDIHGFITKLQNLWSNLESSIDRSQFETATVIFLGDYCDRGPDTRRVIDFLAALPSRHPRQRHVFLCGNHDLAFAAFLRLLPPPSDGSAFSEGWREYEGSEAREGWFKGEGYEDMHLQGRRWSGNITVKFNTAKGTEYQGSIYDAGPTFESYGVPHGSSDLVKAVPDEHKKFLADLVWVHEEDDVFVNTGDGVKCCKLIAVHAGLVKGADVKEQLKLLKARDTRVPKVEALSGRKSVWDIPEELTASGTIVVSGHHAKLHVEDLRLIIDEGGGYKDKPVAAIILPSMKIIRDTDVLAK

SEQ ID NO: 7137 - protein, 313 aa, Vigna unguiculata
MSEPPNPKPRLVICVGDIHGFITKLNNLWSNLERSIERSEFETATVIFLGDYCDRGPDTRLVIDFLVALPSRYPRQKHVFLSGNHDLAFAAFLHLLPPPPDGSPFSDGWKEYSASEEREGWFSGEGFENMHLQGRRWSGKIKERFNTVKGTEYQGSIYDAGPTFESYGVPHGSADLVKAVPDEHKKFLTDLVWVHEEDDVFINTEDGSKCCKLIAVHAGLQKKVDVKEQLKLLKARDTRVPKVEALSGRKTVWDIPEELTTSPTIIVSGHHAKLHIEGLRLIIDEGGGFKDKPVAAIILPSQKIIRDTDVLAE

SEQ ID NO: 7138 - protein, 312 aa, Phaseolus vulgaris
MSELPNPKPRVVICVGDIHGFVTKLKNLWSNLERSIDRSEFETATVIFLGDYCDRGPDTRHVIDFLVALPSRYPRQKHVFLSGNHDLAFAAFLHLLPPPPDGSPFSDGWKEYAASEEREGWFNGEGFENMYLQGRRWSGKIKDKINTVKKTEYQGSIYDAGPTFESYGVPHGSADLVKAVPDEHKKFLADLVWVHEEDDVFINTEDGGKCCKLIAVHAGLEKGDVNEQLKLLKARNTRVPKVEALSGRRSVWDIPEELTASPTIIVSGHHGKLHTEGLRLIIDEGGGFKDRPMAAIVLPSQKVIRDTDVLAK

SEQ ID NO: 7139 - protein, 311 aa, Cicer arietinum
MSESPQPKTVICIGDIHGFITKLQNLWSNLENTLNPSQFQTATIIFLGDYCDRGPQTNQVIDFLITLPARYPNQKHVFLSGNHDFAFAAFLRLLPPPLDGSEFSEGWKEFEDSEEREGWFKGDGYEKMHLQGRRWSGAIKAKFNVAKGTEYQGSIYDARPTFHSYGVPHGSADLVKAVPDEHKKFLADLVWVHEEDDVLMNTDDGVKCCKLIAVHAGLEKGVDVKEQMKILKARDTRIPKLQPLSGRKNVWDIPEELSASPTIIVSGHHAKLHVEGYRLIIDEGGGYQDKPVAAIVLPSMTIIRDTDVLAK

SEQ ID NO: 7140 - protein, 310 aa, Cicer arietinum
SESPQPKTVICIGDIHGFITKLQNLWSNLENTLNPSQFQTATIIFLGDYCDRGPQTNQVIDFLITLPARYPNQKHVFLSGNHDFAFAAFLRLLPPPLDGSEFSEGWKEFEDSEEREGWFKGDGYEKMHLQGRRWSGAIKAKFNVAKGTEYQGSIYDARPTFHSYGVPHGSADLVKAVPDEHKKFLADLVWVHEEDDVLMNTDDGVKCCKLIAVHAGLEKGVDVKEQMKILKARDTRIPKLQPLSGRKNVWDIPEELSASPTIIVSGHHAKLHVEGYRLIIDEGGGYQDKPVAAIVLPSMTIIRDTDVLAK

SEQ ID NO: 7141 - protein, 536 aa, Phaseolus vulgaris
MQRSGYGSDGIFRSLRPSIALPKQPNLTLVSHLFNRVAPFPSKHALIDADSSQTLSFAQLKSLTVKVSHGLLRLGVAKNDVVLFLAPNDIRYIVCFLAVTSLGAIVTTVNPAYTAAEVAKQAKDSNPKFVVTVPELWDKLQHLNLPAVFLHSRAHSNATSFDALVHLAGSPTEFPKVDVKQSDTAVLLYSSGTTGLSKGVVLTHGNFVAASLMIGLDDDLAGEMHSVFLCVLPMFHVFGLMVISYSQLQRGSAVVSLKKFEFELVLKTIEKFSVTHLWVVPPIILALAKHGLVDKYDLSSLKHIGSGAAPLGKELMEECAKRFPRATVAQGYGMTETCGIVSVENTRMGIRHSGSAGMLVAGVEAQIVSVDTLKALPPGQLGEIWVRGPNMMQGYHNNPQATRLTIDKKGWVHTGDLGYFDEDGQLFVVDRIKELIKYKGFQVAPAELEGLLVSHPEILDAVVIPYPDAEAGEVPVAYVVRSPNSSLTEEDVQKFIAKQVAPFKRLRRVTFINAVPKTASGKILRRELIEKVRSKI

SEQ ID NO: 7142 - protein, 539 aa, Cajanus cajan
MQRSGYGSEGIFRSLRPPLVLPKDPNLSLLSHLFTRVSAFPSKPALIDSHTDQTLSFAQLRSLTVKLSHALLRLGVTKNDVVLFLAPNDIRYLVSFLAVTALGAVVTTVNPAYTTAEVSKQAKDSNPKLLVTVPEQWDKLKHLHLPAVFLRSHAPAPPEAGHTFDALLELAASATEFPSVSVAQSDAAALLYSSGTTGVSKGVILTHGNFVASSLMIGMDDELAGEMHSVFLCVLPMFHVFGLVVISYAQLQRGNAVVSLKKFEFELVLKTIERFRVTHLWVVPPIVLALAKHGLVDKYDLSSLKHIGSGAAPLGKELMEECAKRFPRVSVCQGYGMTETCGIVSVENPRMGIRNSGSAGPLVARVEAQIISVDTLKPLPPGQLGEIWVRGPNIMQGYLNNPQATRLTIDRKGWLHTGDLGYFDEDGQLFVVDRIKELIKYKGFQVAPAELEGLLVSHPEILDAVVIPYPDAEAGEVPVAYVVRSPNSSLTEEDVQKFIADQVAPFKRLRRVTFTNAVPKTASGKILRRELIEKVRSKI

SEQ ID NO: 7143 - protein, 541 aa, Lotus japonicus
MQRSGYGSDGIYRSLRPSLVTPKNPNLSLVSHLFTKVSSFPTKPALIDADSNQTLSFSELKTLTVKLSHALLHHFNLAKNDVVLFLAPNSFLYPVCFLAVTSLGAVVSTVNPTYTLPEVSKQANDSAPKLVITVAELWDKVKHLNIPAVFLEPTTVPDSSVINIDELIGLELAGSVTDFPARDIKQGDTAALLYSSGTTGVSKGVILTHGNFIAASLMIGLDDELAGQMHDVFLCVLPMFHVFGFAVITYSQLMRGNAVVSLKRFEFELVLKTVEKYKVTHLWVVPPIVLALAKHGLVDKYDLSSLKHIGSGAAPLGKELMEECAKRFPNVIVCQGYGMTETCGIVSVENPRMGVRHTGSTGMLVAGVEAQIVSVDTMKPLPPGQLGEIWVRGPNMMQGYHNNPQATRLTIDKQGWVHTGDLGYFDEDGQLFVVDRIKELIKYKGFQVAPAELEGLLVSHPEILDAVVIPYPDAEAGEVPVAYVVRSPNSSLTEEDVQKFIANQVAPFKKLRRVTFINTVPKTASGKILRRELIDKARSKI

SEQ ID NO: 7144 - protein, 1029 aa, Glycine max
MAWFRAGTSIAKHAIRRTLSKGGSTYLVSRARFLPSIPSSSSSPYSRSFHSTVFKEQAAPVPRAVPLSKLTDSFLDGTSSVYLEELQRAWEADPNSVDESWDNFFRNFVGQATTSPGISGQTIQESMRLLLLVRAYQVNGHMKAKLDPLNLEPRQISEDLDPALYGFTEADLDREFFLGVWRMAGFLSENRPVQTLRSILTRLEQAYCGSIGYEYMHIADRHKCNWLRDKIETPTPTQFNRERREAIFDRLAWSSLFENFLATKWTSAKRFGLEGGETLIPGMKEMFDRASDLGVESIVIGMAHRGRLNVLGNVVRKPLRQIFCEFSGGLQPEGEVGLYTGTGDVKYHLGTSYDRPTRGGKRIHLSLVANPSHLEAVNPLVIGKTRAKQYYANDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSTLEIYEKNLLESGELTQEEIDRIHKKVTSILNEEFLASKEYIPKRRDWLSAYWLGFKSPEQLSRIRNTGVKPEILKTVGKAITTIPENFTPHRAVKRIYEQRAQMIETGEDIDWGFAEALAYATLLIEGNHVRLSGQDVERGTFSHRHAVVHDQTTGEKYCPLDHVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQVHRDFRKPLIVMSPKNLLRSKACRSNLSEFDDVQGHPGFDKQGTRFKRLIKDQNAHKDVEEGIRRLVLCSGKVYYELDEQRTKVDANDVAICRVEQLCPFPYDLVQRELKRYPNAEVVWCQEEPMNMGGYTYVLPRLISSMKAVNRGGYDDVKYIGRAPSAATATGFLKVHQKEQTEIAEKAVQQEPIDFPF

SEQ ID NO: 7145 - protein, 1029 aa, Cajanus cajan
MAWFRAGASIAKNAIRRSLSKGGSTYLVSRARVLPSSSSTASHNRSFHGTAFKSKAQAAPVPRAVPLSKLTDSFLDGTSSVYLEELQRAWEADPNSVDESWDNFFRNFVGQATTSPGISGQTIQESMRLLLFVRAYQVNGHMKAKLDPLNLEPRQIPEDLDPALYGFTEADLDREFFLGVWRMAGFLSENRPVQTLRSILTRLEQAYCGSIGYEYMHIADRNKCNWLRDKIETPTHTHFNRERREAIFDRLAWSSLFENFLATKWTSAKRFGLEGGETLIPGMKEMFDRASDLGVESIVIGMAHRGRLNVLGNVVRKPLRQIFCEFSGGLQPEDDVGLYTGTGDVKYHLGTSYDRPTRGGKRIHLSLVANPSHLEAVNPVVVGKTRAKQYYSDDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSALEIYQKKLLESGELAQEEIDKIHKKVTSILNEEFLASKEYIPKRRDWLSAYWLGFKSPEQLSRIRNTGVKPDILKNVGKAITTIPEHFTPHKAVKRIYEQRAQMIETGEDIDWGFAEALAFATLLIEGNHVRLSGQDVERGTFSHRHAVVHDQTTGEKYCPLDHVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQVHREFRKPLIVMSPKNLLRSKACRSNLSEFDDVQGHPGFDKQGTRFKRLIKDQNLHSDVEEGIRRLVLCSGKIYYELDDQRTKADAKDVAICRVEQLCPFPYDLVQRELKRYPNAEVVWCQEEPMNMGGYTYILPRLISSMKAVNRGGYDDVKYVGRAPSAATATGFLKVHQKEQSEIAEKAVQQDPIDFPY

SEQ ID NO: 7146 - protein, 1028 aa, Phaseolus vulgaris
MAWFRAGTSIAKQAIRRTLSKGGSTYLVSRARVFPSSSTSSHGRSFHSTVFKSRAQAAPIPRAVPLSKLTDSFLDGTSSVYLEELQRAWEADPSSVDESWDNFFRNFVGQSSTSPGISGQTIQESMRLLLLVRAYQVNGHMKANLDPLNLEAREIPEDLDPALYGFSEADLDREFFLGVWRMAGFLSENRPVQTLRSILTRLEQAYCGNIGYEYMHIADRHKCNWLRDKIETPTITQYNRERREAIFDRLAWSSLFENFLATKWTSAKRFGLEGGETLIPGMKEMFDRASDLGVENIVIGMAHRGRLNVLGNVVRKPLRQIFCEFSSGLQPEDELGLYTGTGDVKYHLGTSYDRPTRGGKRIHLSLVANPSHLEAVNPVVVGKTRAKQYYSNDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRNHPSTLEIYEKKLLESGELSQEEIDKIHKKVTSILNEEFLSSKEYIPKRRDWLSAYWLGFKSPEQLSRIRNTGVKPEILKNVGKAITTIPENFTPHKAVKRIYEQRAQMIETGEDIDWGCAEALAFATLLIEGNHVRLSGQDVERGTFSHRHAVVHDQTTGDKYCPLDHVTMNQDEEMFTVSNSSLSEFGVLGFELGYSMENPNSLIIWEAQFGDFANGAHVIFDNFLASGEAKWLRQTGLVVLLPHGHYGRGPEHSSARLERFLQMADDNPHVIPEMDPTLRKQIQECNLQIVNVTTPANFFHVLRRQVHREFRKPLIVMSPKNLLRSKVCRSNLSEFDDVQGHPGFDKQGTRFKRLIKDQNFLSDVEEGVRRLVLCSGKVYYELDEHRTKGDTKDVAICRVEQLCPFPYDLVQRELKRYPNAEVVWCQEEPMNMGGYSYILPRLVSSMKAVNRGGYDDVKYVGRAPSAATATGFLKVHQKEQTEIAQKSLQQESIDFPY

SEQ ID NO: 7147 - protein, 1022 aa, Cicer arietinum
MAWFRAGASIAKHAIKRTLSQSGSSYLVSRARVLPSSHGRKFQTTVFKEQAAPVPRAVPLSRLTDSFLDGTSSVYLEELQRAWEADPNSVDESWDNFFRNFVGQASTSPGISGQTIQESMRLLLMVRAYQVNGHMKAKLDPLNLEARQIPDDLDPALYGFTEADLDREFFLGVWRMSGFLSENRPVQTLRSILTRLEQAYCGSIGYEYMHISDREKCNWLRDKIETPTPVQFNRERREAIFDRLAWSSLFENFLATKWTSAKRFGLEGGETLIPGMKEMFDRASDLGVESIVIGMAHRGRLNVLGNVVRKPLRQIFCEFSGGLTPEDEVGLYTGTGDVKYHLGTSYDRPTRGGKRIHLSLVANPSHLEAVNPVVVGKTRAKQYYSNDVDRKKNMGVLLHGDGSCAGQGVVYETLHLSALPNYTTGGTIHIVLNNQVAFTTDPMSGRSSQYCTDVAKALNAPIFHVNGDDVEAVVHACELAAEWRQTFHSDVVVDLVCYRRFGHNEIDEPSFTQPKMYKVIRSHPSTLEIYQKKLLETGELTKDDIDKIHTKVTSILNEEFQASKDYIPKRRDWLSAYWLGFKSPEQLSRVRNTGVKPEILKTVGKAITTIPENFTPHKAVKRIYEQRAQMIETGEDIDWGFGEALAFATLLVEGNHVRLSGQDVERGTFSHRHSVVHDQITGEKYCPLDNVIMNQNEELFTVSNSSLSEFAVLGFELGYSMENPNSLIIWEAQFGDFANGAHVIFDNFLASGEAKWLRQTGLVVLLPHGYDGQGPEHSSARLERFLQMADDNPYIIPEMDPTLRKQIQECNLQIVNVTTPANFFHVLRRQIHREFRKPLIVMSPKNLLRSKACRSNLSEFDDVQGHPGFDKQGTRFKRLIKDRNDHSNVEEGIRRLVLCSGKVYYELDEHRSKVDASDVAICRVEQLCPFPYDLVQRELKRYPNAEVVWCQEEPMNMGGYTYILPRLVSSMKAVGRGGFDDVKYVGRAPSAATATGFLKVHQKEQAEIAEKALQREPVNFPF

SEQ ID NO: 7148 - protein, 1023 aa, Medicago truncatula
MAWFRAGASIAKNAIKRTISQNRSSSYLVSRSRILPSTHGRKFHTTVFKQQAAPVPRAVPLSRLTDSFLDGTSSVYLEELQRAWEADPNSVDESWDNFFRNFVGQASTSPGISGQTIQESMRLLLMVRAYQVNGHMKAKLDPLNLEARQIPDDLDPALYGFSEADLDREFFLGVWRMAGFLSENRPVQTLRSILTRLEQAYCGSIGFEYMHISDREKCNWLRDKIETPTPVQFNRERREAIFDRLAWSSLFENFLATKWTSAKRFGLEGGETLIPGMKEMFDRASDLGVESIVIGMAHRGRLNVLGNVVRKPLRQIFCEFSGGLSPEDEVGLYTGTGDVKYHLGTSYDRPTRGGKRIHLSLVANPSHLEAVDPVVVGKTRAKQYYSNDVDRTKNMGILLHGDGSFAGQGVVYETLHLSALPNYTTGGTIHIVLNNQVAFTTDPMSGRSSQYCTDVAKALDAPIFHVNGDDVEAVVHACELAAEWRQTFHSDVVVDLVCYRRFGHNEIDEPSFTQPKMYKVIRSHPSTLEIYQKKLLETGELTQDDIDKIHKKVTSILNEEFQASKDYIPKRRDWLSAYWLGFKSPEQLSRVRNTGVKPEILKTVGKAITTIPENFTPHKAVKRIYEQRAQMIETGEDIDWGFGEALAFATLLVEGNHVRLSGQDVERGTFSHRHSVVHDQTTGEKYCPLDNVILNQDEEMFTVSNSSLSEFAVLGFELGYSMENPNSLIIWEAQFGDFANGAHVIFDNFLASGEAKWLRQTGLVVLLPHGYDGQGPEHSSARLERFLQMADDNPYIIPEMDPTLRKQIQECNLQIVNVTTPANFFHVLRRQIHREFRKPLIVMSPKNLLRSKSCRSNLSEFDDVQGHPGFDKQGTRFKRLIKDRNDHNTVEEGIRRLVLCSGKVYYELDDHRSKVDASDVAICRVEQLCPFPYDLVQRELKRYPNAEVVWCQEEPMNMGGYTYILPRLVSSMKAVGRGGFDDVKYVGRAPSAATATGFLKVHQKEQAEIAEKALQREPVNFPF

SEQ ID NO: 7149 - protein, 1021 aa, Glycine max
MAWFRVASSIVKHDAIRRNLYRGAKRTSTVLPSTSRIRKFHTTVVKSKEQTAPVPRPVPLSKLTDNFLDGTSSVYLEELQRAWEADPDSVDESWDNFFRNFVGQASTSPGISGQTIQESMQLLLLVRAYQVNGHMKAKLDPLGLEERKVPDELDPAFYGFTEADLDREFFLGVWKMSGFLSENRPVQTLRFILSRLQQAYCGSIGYEYMHIPDREKCNWLRDRIETPTPTQYNRERREVIFDRLAWSTLFENFLATKWTSAKRFGLEGGESVIPGMKEMFDRASDLGVESIVMGMAHRGRLNVLGNVVRKPLRQIFCEFSGGQPADEVGLYTGTGDVKYHLGTSYDRPTRGGRRIHLSLVANPSHLEAVNPLVVGKTRAKQYYSNDVDRMKNMGVLIHGDGSFAGQGVVYETLHLSALPNYTTGGTIHIVFNNQVAFTTDPKSGRSSQYCTDVAKALNAPIFHVNGDDVEAVVHVCELAAEWRQTFHSDVVVDFVCYRRFGHNEIDEPSFTQPKMYKVIRNHPSALEIYQKKLLESGELTQEDIDKIHKKVTSILNDEFLASKDYVPKRRDWLSAYWSGFKSPEQISRIRNTGVKPEILKSVGKAITILPKFFSPHKAVKRIYEQRAQMVETGEDIDWGFAEALAFATLIVEGNHVRLSGQDVERGTFSHRHAVVHDQTTGEIYCPLDHVIMNQNEEMFTVSNSSLSEFGVLGFELGYSMENPNSLVIWEAQFGDFANGAQVIFDNFLSSGESKWLRQTGLVVLLPHGYDGQGPEHSSGRLERFLQMADDHPYVIPEMDPTLRKQIQECNWQIVNVTTPANFFHVLRRQIHREFRKPLIVMSPKNLLRSKACRSNLSEFDDVQGHPGFDKQGTRFKRLIKDQNNHSDVEEGIRRLVLCSGKVYYELDEQRTKEDAKDVAICRVEQLCPFPYDLVQRELKRYPNAEVVWCQEEPMNMGGYTYILPRLISSMKAVGRGGYEDVKYVGRAPSAATATGFLKVHLNEQAELVQKAIQREPINFPY

SEQ ID NO: 7150 - protein, 1023 aa, Lotus japonicus
MAWFRAAALSIAKHAIRRNLFRGGSSYYVTRTTNLPSTSRKLHTTIFKSEAHAAPVPRPVPLSRLTDNFLDGTSSAYLEELQRAWEADPSSVDESWDNFFRNFVGQASTSPGISGQTIQESMRLLLLVRAYQVNGHMKAKLDPLGLKERNIPDELDPGLYGFTEADLDREFFLGVWNMSGFLSENRPVQTLRSILTRLEQAYCGSIGYEYMHIPDRDKCNWLRDKIETPSPTQFSRERREVIFDRLAWSTLFENFLATKWTSAKRFGLEGGETLIPGMKEMFDRASDLGVENIVMGMAHRGRLNVLGNVVRKPLRQIFCEFSGGLPQDEVGLYTGTGDVKYHLGTSYDRPTRGGRRIHLSLMANPSHLEAVNPLVVGKTRAKQYYSNDAERMKNMGVLIHGDGSFAGQGVVYETLHLSALPNYTTGGTIHIVFNNQVAFTTDPESGRSSQYSTDVAKALNAPIFHVNGDDVESVVHVCELAAEWRQTFHSDVVVDLVCYRRFGHNEIDEPSFTQPKMYKVIRNHPSALEIYQKKLLELGELTQEDIDKIHKKVTSILNDEFLASKDYIPKRRDWLSAYWSGFKSPEQLSRIRNTGVKPDILKNVGKAITALPESLNPHRAVKKVYEQRAQMVETGEDIDWGFAEALAFATLIVEGNHVRLSGQDVERGTFSHRHAVVHDQATGEKYCPLDHVIMNQNEEMFTVSNSSLSEFGVLGFELGYSMENPNSLVIWEAQFGDFANGAQVIFDNFLSSGESKWLRQTGLVVLLPHGYDGQGPEHSSGRLERYLQMADDHPYIIPEMDPTLRKQIQECNLQIVNVTTPANFFHVLRRQIHREFRKPLIVMSPKNLLRSKVCRSNLSEFDDVQGHPGFDKQGTRFKRLIKDQNDHSNVEEGIRRLILCSGKVYYELDEQRTKDDAKDVAICRVEQLCPFPYDLVQRELKRYPNAEVVWCQEEPMNMGGYSYILPRLITSMKALGRGGYEDVKYVGRAPSAATATGFLKVHQREQAELVHKAMQHKPINFPY

SEQ ID NO: 7151 - protein, 1023 aa, Cajanus cajan
MAWFRVVASSIAKHGTIRRSLYGGGGGSLHCVRRTTAAGTNRIRNFHSTIFKSKAQPAPVPLSKLTDNFLDGTSSVYLEELQRAWEADPSSVDESWDNFFRNFVGQAPTSPGISGQTIQESMRLLLLVRAYQVNGHMKAKLDPLGLEERKVPDELDLSLYGFSEADLDREFFLGVWKISGFLSENRPVQTLRSILTRLEQAYCGSIGYEYMHIPDRGKCNWLREKIETPVPTQYNRERREVIFDRLAWSTLFENFLATKWTSAKRFGLEGGESVIPGMKEMFDRASDLGVESIVMGMAHRGRLNVLGNVVRKPLRQIFCEFSGGQPQDEVGLYTGTGDVKYHLGTSYDRPTRGGRRIHLSLVANPSHLEAVNPLVVGKTRAKQYYSNDVDRKKNMGVLIHGDGSFAGQGVVYETLHLSALPNYTTGGTIHIVFNNQVAFTTDPKSGRSSQYCTDVAKALNAPIFHVNGDDVEAVVHVCELAAEWRQTFHSDVVVDLVCYRRFGHNEIDEPSFTQPQMYKVIRNHPSALEIYQKKLLESGELTQEDIDKIHKKVTSILNDEFLASKDYIPKRRDWLSAYWSGFKSPEQLSRIRNTGVKPEILKNVGKAITILPENFTPHKAVKRIYEQRAQMVEIGEDIDWGFAEALAFATLIVEGNHVRLSGQDVERGTFSHRHAVVHDQTTGDIYCPLDHVIMNQNEEMFTVSNSSLSEFGVLGFELGYSMENPNSLVIWEAQFGDFANGAQVIFDNFLSSGESKWLRQTGLVVLLPHGYDGQGPEHSSGRLERFLQMADDHPYVIPEMDPTLRKQIQECNWQIVNVTTPANFFHVLRRQIHREFRKPLIVMSPKNLLRSKACRSNLSEFDDVQGHPGFDKQGTRFKRLIKDQNNHSDVEEGIRRLVLCSGKVYYELDEQRTKEDAKDVAICRVEQLCPFPYDLVQRELKRYPNAEVVWCQEEPMNMGGYTYVLPRLVTSMKSLGRGGYEDVKYVGRGPSAATATGFLKVHLKEQTELVQKAIQREPINFPY

SEQ ID NO: 7152 - protein, 1026 aa, Phaseolus vulgaris
MAWLRVASSIAKHDAVRRNLYGGGARYCVKRTTTILPSTSRIRNFHTTVFKFKEQTASVPRPVPLSKLTDNFLDGTSSVYLEELQRAWEADPNSVDESWDNFFRNFVGQASTSPGISGQTIQESMQLLLLVRAYQVNGHMKAKLDPLGLEERKVPDELDLAFYGFTEADLDREFFLGVWKMSGFLSENRPVQTLRSILTRLEQAYCGSIGYEYMHIPDREKCNWLRDRIETLTPTQYNRERREVIFDRLAWSTLFENFLATKWTSAKRFGLEGGESIVPGMKEMFDRASDLGVESIVMGMAHRGRLNVLGNVVRKPLRQIFCEFSGGQPADEVGLYTGTGDVKYHLGTSYDRPTRGGKRIHLSLVANPSHLEAVNPLVVGKTRAKQYYSNDKNRMKNMGVLIHGDGSFAGQGVVYETLHLSALPNYTTGGTIHIVFNNQVAFTTDPKSGRSSQYCTDVAKSLNAPIFHVNGDDVEAVVHVCELAAEWRQTFHSDVVVDLVCYRRFGHNEIDEPSFTQPKMYKVIRNHPSAFEIYQKKLLESGELTREDVDKIHRKVTSILNDEFLASKDYVPKRRDWLSAYWSGFKSPEQISRIRNTGVKPEILKNVGKAITLLPENFTPHKAVKRIYEQRSQMVETGEDIDWGFAEALAFATLIVEGNHVRLSGQDVERGTFSHRHAVVHDQTTGERYCPLDHVIMNQNEEMFTVSNSSLSEFGVLGFELGYSMENPNSLVIWEAQFGDFANGAQVIFDNFLSSGESKWLLTAGLVVLLPHGYDGQGPEHSSGRLERFLQMADDHPYTIPEMDPTLRKQIQECNWQIVNVTTPANFFHVLRRQIHREFRKPLIVMSPKNLLRSKVCRSNLTEFDDVQGHPGFDKQGTRFKRLIKDQNNHSDVEGGIRRLVLCSGKVYYELDEQRTKEDAKDVAICRVEQLCPFPYDLVQRELKRYPNAEVVWCQEEPMNMGGYTYILPRLITSMKVLGRGGYEDVKYVGRAPSAATATGFLKVHLKEQAELVQKAIQQEPISFPY

SEQ ID NO: 7153 - protein, 1024 aa, Cicer arietinum
MGWWYRAASSIAKRSIRRNFYRGELSCYATRTSILPSTSRNFQTTVFKPKAQTAPVPHSVPLSRLADNFLDGTSSVYLEELQRAWEADPNSVDESWDNFFRNFVGQAPTSPGISGQTIQESMRLLLLVRAYQVNGHMKAKLDPLGLEVRKIPDELDPSLYGFTEADLDREFFLGVWNMSGFLSENRPVQTLRSILTRLEQAYCGSIGFEYMHIPDRDKCNWLREKIETSAPTQFSRKRREDIFDRLAWSTLFENFLATKWTSAKRFGLEGGETLIPGMKEMFDHASDLGVESIVMGMAHRGRLNVLGNIVRKPIRQIFCEFSGGVLPVDEAGLYTGTGDVKYHLGTSYDRPTRGGKRIHLSLLANPSHLEAVNPLVVGKTRAKQYYSDDVEREKHMGVLIHGDGSFAGQGVVYETLHLSALPNYTTGGTIHIVLNNQVAFTTDPKAGRSSQYSTDVAKAINAPIFHVNGDDVEAVVHVCELAAEWRQTFHSDVVVDLVCYRRFGHNEIDEPSFTQPKMYKVIRNHPSALEIYQKKLLELGELTKGDVDKIHQKITSILNEEFLASKDYVPKRRDWLSAYWSGFKSPEQISRIRNTGVKPEILKNVGKAITVLPGNLTPHKAVKRIYEQRAQMIETGEDIDWGFAEALAFATLVVEGNHVRLSGQDVERGTFSHRHAVVHDQTNGEKYCPLDHVIINQNKELFTVSNSSLSEFGVLGFELGYSMENPNSLVIWEAQFGDFANGAQVIFDNFLSSGESKWLRQTGLVVLLPHGYDGQGPEHSSGRLERFLQMADGHPYIIPEMDPTLGKQIQECNWQIVNVTTPANFFHVLRRQIHREFRKPLIVMSPKNLLRSKVCRSNLSEFDDVQGHPGFDKQGTRFKRLIKDRNDHSNVEEGIRRLILCSGKVYYELDDQRSKVDAKDVAICRVEQLCPFPYDLVQRELNRYPNAEVVWCQEEPMNMGGYTYVLPRLITSMKSIGRGGYEDVKYVGRAPSAATATGFLKVHQKEHVELLGKALQSEPINFPY

SEQ ID NO: 7154 - protein, 596 aa, Citrullus lanatus
MRWFRASSAVAKLAIKRNILQGGPYVGRSRISTSQSRYFHTTLFKSKAQGAPVPRAVPLSRLTDSFLDGTSSVYLEELQRAWEADPTSVDESWDNFFRNFVGQAATSPGISGQTIQESMRLLLLVRAYQVNGHMKAKLDPLGLEERKIPDELDLAHHGFTEADLDREFFLGVWKMSGFLSENRPVQTLRYTLTRLEQAYCGSIGYEYMHIADREKCNWLRDKIETPTPTQYNRQRKEVILDRLLWSTQFENFLATKWTTAKRFGLEGGETLIPGMKEMFDRAADLGVESIVIGMPHRGRLNVLGNVVRKPLRQIFSEFSGGTKPVNEVGLYTGTGDVKYHLGTSYDRPTRGGKRLHLSLLANPSHLEAVDPVVVGKTRAKQYYSNDVERKKNMGILIHGDGSFAGQGVVYETLHLSALPNYTTGGTIHIVVNNQVAFTTDPRSGRSSQYCTDVAKALNAPIFHVNGDDVEAVVHVCELAAEWRQSFHSDVVVDLVCYRRFGHNEIDEPSFTQPKMYQVIRNHPSSLEIYRKKLLELEQVSQEDIEKMQSKVNSILNEEFVASKDYVPKKRDWLSAYWAGFKSPEQLSRIRNTGHVE

SEQ ID NO: 7155 - protein, 596 aa, Cucumis sativus
MRWFRASAAVAKLAIKRNILQGGSYVGRSRISTSQSRYFHSTLFKSRAQSAPVPRPVPLSRLTDSFLDGTSSVYLEELQRAWEADPTSVDESWDNFFRNFVGQAATSPGISGQTIQESMRLLLLVRAYQVNGHMKAKLDPLGLEERKIPEELDLAHHGFTEADLDREFFLGVWKMAGFLSENRPVQTLRYTVTRLEQAYCGSIGYEYMHIADREKCNWLRDKIETPTPTQYNRQRKEVILDRLLWSTQFENFLATKWTTAKRFGLEGGETLIPGMKEMFDRASDLGVESIVIGMPHRGRLNVLGNVVRKPLRQIFSEFSGGTKPVNEVGLYTGTGDVKYHLGTSYDRPTRGGKRLHLSLLANPSHLEAVDPVVVGKTRAKQYYSNDAERKKNMGILIHGDGSFAGQGVVYETLHLSALPNYTTGGTIHIVVNNQVAFTTDPRSGRSSQYCTDVAKALNAPIFHVNGDDVEAVVHVCELAAEWRQTFHSDVVVDLVCYRRFGHNEIDEPSFTQPKMYKVIRNHPSSLEIYRKKLLELEQVSQEDIQKMQSKVNSILNEEFVASKDYVPRKRDWLSAYWAGFKSPEQLSRIQNTGHVE

SEQ ID NO: 7156 - protein, 996 aa, Eutrema halophilum
MVWFRAGSSVTKLAVRRILNQGGSYATRTRSLPSQNRSFHSTIYRPKAQSAPVPRAVPLSKLTDSFLDGTSSVYLEELQRAWESDPNSVDESWDNFFRNFVGQAATSPGISGQTIQESMRLLLLVRAYQVNGHMKAKLDPLGLEQREIPEDLDLALYGFTEADLDREFFLGVWQMSGFMSENRPVQTLRSILTRLEQAYCGNIGFEYMHIADRDKCNWLREKIETPTPWRYNRERREVILDRLAWSTQFENFLATKWTTAKRFGLEGGESLIPGMKEMFDRAADLGVESIVIGMSHRGRLNVLGNVVRKPLRQIFSEFSGGIRPVDEVGYTGTGDVKYHLGTSYDRPTRGGKKIHLSLVANPSHLEAADSVVVGKTRAKQYYSKDLDRTKNLGILIHGDGSFAGQGVVYETLHLSALPNYTTGGTIHIVVNNQVAFTTDPRAGRSSQYCTDVAKALSAPIFHVNGDDVEAVVHACELAAEWRQTFHSDVVVDLVCYRRFGHNEIDEPSFTQPKMYKVIKNHPSTLQIYHKKLLECGEVSQQDIDRIQEKVNTILNEEFVASKDYLPKKRDWLSTNWAGFKSPEQISRVRNTGSFLFSLENFKPHRAVKKVYEQRAQMIESGEGIDWALAEALAFATLVVEGNHEPFSHRHSVLHDQETGEEYCPLDHLIMNQDPEMFTVSNSSLSEFGVLGFELGYSMESPNSLVLWEAQFGDFANGAQVIFDQFISSGEAKWLRQTGLVVLLPHGYDGQGPEHSSARLERYLQMSDDNPYVIPDMEPTMRKQIQECNWQIVNATTPANYFHVLRRQIHRDFRKPLIVMAPKNLLRHKDCKSNLSEFDDVQGHPGFDKQGTRFKRLIKDQNDHSDLEEGIRRLVLCSGKVYYELDDERKKVGAKDVAICRVEQLCPFPYDLIQRELKRYPNAEIVWCQEEAMNMGAFSYISPRLWTAMRSLGRGDMEDIKYVGRGPSAATATGFYTFHVKEQAELVQKAIGKEPIN

SEQ ID NO: 7157 - protein, 329 aa, Glycine max
MKSMVTPLTRVLPFRHPNGYNTLPFSLTRYPSSPNFSFSFSPLTLTLSMAASPQSSAPTVSPGDANINKDGVFQLIQAHQEKAARLPPVEEIRTVLDRSVRGMLSTFSKKFDGYPSGSMVDFACDSNGYPILAVSDLAVHSKDLTANPKCSLLVARDPEDRTDLVITVHGDAISVPENEREAVRAAYLARHPNAFWVDFGDFRFLRIEPKVVRFVSGVATALLGSGEFSGDEYKSAKVDPIAQFSKPVASHMNKDHAEDNKVIVQHWTSVPVLDFADILDLDSLGFNVKAGYQGDTFKLRVPFPRRAEDRKDVKTLIVEMLQAARPKVD

SEQ ID NO: 7158 - protein, 283 aa, Cajanus cajan
MKSMVSPLTRVSPFCRRNGQNALLFSPTFTRYPSSPNTDTFSPLTLTLSMAASPQSSAPTVSPGDVNMDKDGVFQLIQAHQEKAARLPPVEEIRTVLDRSVRGMLSTFSKKFESYPSGSMVDFACDANGYPILAVSDLAVHSKDLTANPKCSLLVARDPEDRTDLVITLHGDAIAVPENDKEAVRAAYLARHPNAFWVDFGDFRFLRIEPKVVRFVSGVATALLGSGEFSRDEYKSAKVDPIAQFSKPVASHMNKDHAEDNKVIVQHWTSVPVCGLCLYTGFG

SEQ ID NO: 7159 - protein, 327 aa, Phaseolus vulgaris
MKSMVTPLMRVSPFRHQNGHNTLPLFSLARYPSSPNFSFSPLSLSLSMAASSQSSSPAVSRGDANMDKDGVFQLIQAHQEKAARLPPVEEIRTVLDRSVRGMLSTFSKKFDGYPSGSMVDFACDANGYPILAVSDLAVHSKDLTANSKCSLLVARDPEDRTDLVITLHGDAITVPEKDKEAVRAAYLARHPNAFWVDFGDFQFLRIEPKVVRFVSGVATALLGSGEFTGDEYKSAKVDPVAQFSKPVTSHMNKDHADDNKVIVQHWTSVPVDFAYLLDLDSLGFNVKAGYQDDTFKLRVPFPRRAEDRKDVKTLIVEMLQAARPKAE

SEQ ID NO: 7160 - protein, 327 aa, Cicer arietinum
MKSMVTPLTRVTPIFRPNAYNALRFSPKPLHSSLPNSFIFTSPTPTLSMAASSQSTAPAVSSGDVNIKKDDVFQLIKAHQEKAARLPPVEEIRTVLDRSVRGMLSTFSKKFEGYPSGSMVDFACDANGCPILAVSDLAVHSKDLTANPKCSVLLARDPEDRTDLVITLHGDAIFVPEKDKEAIRAAYLARHPNAFWVDFGDFRFVRIEPKVVRFVSGVATALLGSGEFNGDEYKSAKVDPIAQFSKPVASHMNKDHSDDTKAIVQHWTSVPVDFAYILDLDRLGFNVKAGYQGDTFKLRVPFPRPAEDRKDVKTLIVEMLQASKPQV

SEQ ID NO: 7161 - protein, 329 aa, Lotus japonicus
MKTMVTPLMRISPSFRQNAHKALPFSPTRHSSSPNSFTFISAIPTLSISMAASSQSTAPAVPSGDVGMKKDEVFQLIQAHQEKAARLPPVEQVRTVLDHSLRGVLSTFSKKYEGYPSGSMVDFACDANGCPILAVSDLAVHTKDLTANPKCSLLVARDPEDRTDLVITLHGDAVSVPEKDKEAVRAAYLARHPNAFWVDFGDFQFVRIKPKTVRFVSGVATALLGSGEFDGDEYKSAKVDPVAQFSKPVASHMNKDHGEDTKVIVQHWTSVPVDFADILDLDCLGFNVKAGYQGDTFKLRVPFPRRAEDRKDVKTLIVEMLQAARPQGD

SEQ ID NO: 7162 - protein, 210 aa, Trigonella foenum-graecum
MVDFACDENGCPILAVSDLAVHSKDLTANPKCSVLLARDPEDRTDLVITLHGDAIFVPEKDKEAVRAAYLARHPNAFWVDFGDFRFVRIEPKVVRFVSGVATALLGSGEFNGDEYKSAKVDPVAQFSKPVASHMNKDHGEDTKAIVQHWTSVPVDFANILDLDRLGFNVKAGYQGDTFKLRVPFPRPAEDRKDVKTLIVEMLQAARTQVD

SEQ ID NO: 7163 - protein, 325 aa, Pisum sativum
MKTMVTPLTRVSTFFRSNAHNALPFSPKSRNPSLPNFFTFTSPSLSMAASSQSTAPVASSGDVNIEKDDIFQLIQAHQEKAARLPPLEEIRTVLDLSVRGTLSTFSKKYDGYPSGSMVDFACDANGCLILAVSDLAVHSKDLAANPKCSVLVARDPEDRTDLVITFHGDAIFVPEKDNEAIRAAYLARHPNAFWVDFGDFRFVRIEPKVVRFVSGVATALLGSGEFSGDEFKSAKVDPISQFSKPVASHMNKDHGEDTKMIVQHWTSVPVDFADILDLDRLGFNVKAGFKGDTFKLRVPFPRPAEDRKDVKTLIVEMLQAAKPQV

SEQ ID NO: 7164 - protein, 328 aa, Medicago truncatula
MKTMVTPLTRVSTFFRPIPYNALPFSPKPRFSFLPNSFTFTSLTPSLSMASSSQSTAQVVSSGDVNNKKDDVFQLIQAHQEKAARLPPVEEIRTVLDRSLRGTLSTFSKKYDGYPSGSMVDFACDANGCPILAVSDLAVHSKDLAANPKCSVLLARDPEDRTDLVITLHGDAIFVPEKDKEAIRAAYLARHPNAFWVDFGDFRFVRIEPKVVRFVSGVATALLGSGEFTGDEYKSAKVDPIAQFSKPVASHMNKDHGEDTKAIVQHWTSVPVDFADIIDLDRLGFNIKAGYKGDKFKLRVPFPRPAEDRKDVKTLIVEMLQAAKPQVN

SEQ ID NO: 7165 - protein, 280 aa, Vigna unguiculata
MAASPQSSAPAASRGDAKIDKDGVFQLIQAHQEKAARLPPLEEIRTVLDRSVRGMLSTFSKKFDGYPSGSMVDFACDANGYPILAVSDLAVHSKDLTANPKCSLLVARDPEDRTDLVITIHGDAITVPEKDKEAVRAAYLARHPNAFWVDFGDFKFLRIEPKVVRFVSGVATALLGSGEFTGDEYQSAKVDPIAQFSKPVASHMNKDHADDNKVIVQHWTSVPVDFAYLLDMDSLGFNVKAGYQGDTFKLRVPFPRRAEDRKDVKTLIVEMLQAAGPKAE

SEQ ID NO: 7166 - protein, 338 aa, Arachis hypogaea
MKTMVTPLMKISPFSRPNGIYINKPSSLVPLSPLTPQRNSSSPNSLTFPTLTPTLSVSMAASPQSTAPTASPGGVNINKDDVFQLIQAHQEKAARLPPVEEIRTFLDRSVRGMLSTYSKKFEGYPSGSMVDFACDANGYPILAVSDLAVHTKDLAANPKCSLLVPRDPEDRTDLVVTLHGDAVSVPENDKEAVRAAYLARHPNAFWVDFGDFHFLRIEPKVVRYVSGVATALLGSGEFSPDEYKAAKVDPLAQFSKPVASHMNKDHAEDTTVIVQHWTSVPVESAYMLDVDSVGFNVKAGYKGDTFKLRVPFPRRAADRKDIKTLIVEMLQAARPHVD

SEQ ID NO: 7167 - protein, 138 aa, Solanum phureja
MSGEEEENAAELKIGDEFLKAKCLMNCEVALILEHKYEQLQQMSDDPTNQISQVFEKSLQYVKRFSRYKNPDAVRQAREILSRYPLAEFELCVLGNLCPETVEEGIAMVPSIKNRGRALDEEAIEKMLTDLSLIKKFE

SEQ ID NO: 7168 - protein, 138 aa, Solanum melongena
MSGEEEENAAELKIGDEFLKAKCLMNCEVALILEHKYEQLQQMSDDPTNQISQVFEKSLQYVKRFSRYKNPDAVRQAREILSRYPLAEFELCVLGNLCPETVEEAIAMVPSIKNRGRALDEEAIEKMLTDLSLIKKFE

SEQ ID NO: 7169 - protein, 138 aa, Nicotiana tabacum
MSGEEEENAAELKIGDEFLKAKCLMNCEVALILEHKYEQLQQMSEDPTNQISQVFEKSLQYVKRFSRYKNPDAVRQAREILSRYPLAEFELCVLGNLCPETVEEGIAMVPSIKNRGRALDEEAIEKMLTDLSLIKKFE

SEQ ID NO: 7170 - protein, 138 aa, Capsicum annuum
MSGEEEENAAELKIGDEFLKAKCLMNCEVALILEHKYEQLQQMSDDPTTQISQVFEKSLQYVKRFSRYKNPDAVRQAREILSRYPLAEFELCVLGNLCPETVEEAIAMVPSIKNRGRALDEEAIEKMLNDLSLIKKFE

SEQ ID NO: 7171 - protein, 141 aa, Petunia hybrida
MSGPSMEEEENAAELKIGDEFLKAKCLMNCEVALILEHKYEQIQQMSDDPTNQVSQVFEKSLQYVKRFSRYKNPDAVRQAREILSRFPLAEFELCVLGNLCPETVEEGIAMVPSIKNRGRALDEEAIEKMLTDLSLIKKFE

SEQ ID NO: 7172 - protein, 138 aa, Ipomoea nil
MSVEEEENAAELKIGDEFLKAKCLMNCEVSLILEHKYEQIQQMSEDPTNQVSQVFEKSLQYVKRFSRYKNPDAVRQVREILSRYKLAEFELCVLGNLCPETVEEAIAMVPSIKNRGRALDDEAIEKMLNDLSLIKKFE

SEQ ID NO: 7173 - protein, 138 aa, Unknown
  Sequence found in Organisms: Nicotiana benthamiana, Nicotiana tabacum
MSLEEEENAAELKIGDEFLKAKCLMNSEVSLILEHKYEQIQQMSDDPSNQVSQVFEKSLQYVKRFSRYKNPDAVRQVREILSRYQLAEFELCVLGNLCPETVEEAIAMVPSIKNRGRMLDEEAIEKMLNDLSLIKKFE

SEQ ID NO: 7174 - protein, 138 aa, Nicotiana benthamiana
MSMEEEENAAELKIGDEFLKAKCLMNSEVSLILEHKYEQIQQMSDDPSNQVSQVFEKSLQYVKRFSRYKNPDAVRQVREILSRYQLAEFELCVLGNLCPETVEEAIAMVPSIKNRGRMLDEEAIEKMLNDLSLIKKFE

SEQ ID NO: 7175 - protein, 138 aa, Eucalyptus grandis
MSGEEEENAAELKIGDEFLKAKCLMNCEVSLILEHKYEQLQQMSDDPMNQVSQVFEKSLQYVKRFSRYKNPDAVRQVREILSRYQLAEFELCVLGNLCPETVEEAIAMVPSIKNRGRALDDEAIEKMLNDLSLIKRFE

SEQ ID NO: 7176 - protein, 138 aa, Carica papaya
MSGEEEENAAELKIGDEFLKAKCLMNCEVALILEHKYEQIQQMSEDPMNQVSQVFEKSLQYVKRFSRYKNPDAVRQVREILSRYQLAEFELCVLGNLCPETVEEAIAMVPSIKTKGRAHDDEAIEKMLTDLSLIKKFE

SEQ ID NO: 7177 - protein, 138 aa, Sarracenia psittacina
MSAEEGENAAELKIGDEFLKAKCLMNCEVALILEHKYEQLQQMADDPMNQISQVFEKSLQYVKRFSRYKNPDSVRQAREILSRYQLAEFELCVLGNLCPETVEEAIAMVPSIKSRGRALDDEAIEKMLNDLSLIKKFE

SEQ ID NO: 7178 - protein, 138 aa, Tabernaemontana elegans
MSGEEEENAAELKIGDEFLKAKCLMNCEVALILEHKYEQLQQMSEDPMNQMSQVFEKSLQYVKRFSRYKNPDSVRQVREILSRYQLAEFELCVLGNLCPETVEEAIAMVPSIKNRGRALDDEAIEKMLNDLSLVKKFE

SEQ ID NO: 7179 - protein, 138 aa, Tripterygium wilfordii
MSGEEEENAAELKIGDEFLKAKCLMNCEVALILEHKYEQLQQMSDDPTNQISQVFEKSLQYVKRFSRYKNPDAVRQVREILSRYQLAEFELCVLGNLCPETVEEAIAMVPSIKTKGRGHDDEAIEKMLNDLSLVKKFE

SEQ ID NO: 7180 - protein, 138 aa, Vinca minor
MSGEEEENAAELKIGDEFLKAKCLMNCEVSLILEHKYEQLQQMSEDPMNQISQVFEKSLQYVKRFSRYKNPDSVRQVREILSRYKLAEFELCVLGNLCPETVEEAIAMVPSIKNRGRALDDEAIEKMLNDLSLVKKFE

SEQ ID NO: 7181 - protein, 138 aa, Amsonia hubrichtii
MSGEEEENAAELKIGDEFLKAKCLMNCEVSLILEHKYEQLQQMSEDPMNQMSQVFEKSLQYVKRFSRYKNPDSVRQVREILSRYQLAEFELCVLGNLCPETVEEAIAMVPSIKNRGRALDDEAIEKMLNDLSLVKKFE

SEQ ID NO: 7182 - protein, 138 aa, Unknown
  Sequence found in Organisms: Fagus grandifolia, Castanea mollissima, Quercus alba
MSGEEEENAAELKIGDEFLKAKCLMNCEVALILEHKYEQLQQMSEDPMNQVSQVFEKSLQYVKRFSRYKNPDAVRQVREILSRYQLAEFELCVLGNLCPETVEEAIAMVPSIKTKGRAHDDEAIEKMLNDLSLIKKFE

SEQ ID NO: 7183 - protein, 138 aa, Vaccinium corymbosum
MSGEEEENAAELKIGDEFLKAKCLMNCEVALILEHKYEQLQQMADDPMNQVSQVFEKSLQYVKRFSRYKNPDAVRQAREILSRYQLAEFELCVLGNLCPDTVEEAIAMVPSMKSRGRALDEEAIEKMLNDLSMIKKFD

SEQ ID NO: 7184 - protein, 138 aa, Manihot esculenta
MSGEEEENAAELKIGDEFLKAKCLMNCEVALILEHKYEQLQQMSDDPMNQVSQVFEKSLQYVKRFSRYKNPDAVKQVREILSRYQLAEFELCVLGNLCPETVEEAIAMVPSIKTKGRAHDDEAIEKMLNDLSLIKKFE

SEQ ID NO: 7185 - protein, 138 aa, Euonymus alatus
MSGEEEENAAELKIGDEFLKAKCLMNCEVALILEHKYEQLQQMSDDPMNQISQVFEKSLQYVKRFSRYKNPDAVRQVREILSRYQLAEFELCVLGNLCPETVEEAIAMVPSIKTKGRGHDDEAIEKMLNDLSLVKKFE

SEQ ID NO: 7186 - protein, 138 aa, Vitis vinifera
MSGEEEENAAELKIGDEFLKAKCLMNCEVAVILEHKYEQLQQMSDDPLNQVSQVFEKSLQYVKRFSRYKNPDAVRQVREILSRYQLAEFELCVLGNLCPETVEEAIAMVPSIKTKGRAHDDEAIEKMLNDLSLIKKFE

SEQ ID NO: 7187 - protein, 138 aa, Cajanus cajan
MSGEEEENAAELKIGDEFLKAKCLMNCEVALILEHKYEQLQQTSDDPTSQISQVFEKSLQYVKRFSRYKNPDAVRQVREILARYQLTEFELCVLGNLCPETVEEAIAMVPSIKTRGRAQDDEAIEKMLNDLSLIKKFE

SEQ ID NO: 7188 - protein, 138 aa, Populus trichocarpa
MSGEEEENAAELKIGDDFLKAKCLMNCEVALILEHKYEQLQQMSDDPMNQVSQVFEKSLQYVKRFSRYKNPDAVRQVREILSRYQLAEFELCVLGNLCPETVEEAIAMVPSIKTKGRAHDDEAIEKMLNDLSLIKKFE

SEQ ID NO: 7189 - protein, 114 aa, Sarracenia psittacina
MNCEVALILEHKYEQLQQMADDPMNQISQVFEKSLQYVKRFSRYKNPDSVRQAREILSRYQLAEFELCVLGNLCPETVEEAIAMVPSIKSRGRALDDEAIEKMLNDLSLIKKFE

SEQ ID NO: 7190 - protein, 138 aa, Glycine max
MSGEEEENAAELKIGDEFLKAKCLMNCEVALILEHKYEQLQQTSDDPMNQVSQVFEKSLQYVKRFSRYKNPDAVRQVREILARYELAEFELCVLGNLCPETVEEAIAMVPSIKSRGRAQDDEAIEKMLNDLSLIKKFE

SEQ ID NO: 7191 - protein, 138 aa, Glycine max
MSGEEEENAAELKIGDEFLKAKCLMNCEVSLILEHKYEQLQQTSDDPMNQISQVFEKSLQYVKRFSRYKNPDAVRQVREILARYQLAEFELCVLGNLCPETVEEAIAMVPSIKSRGRAQDDEAIEKMLNDLSLIKKFE

SEQ ID NO: 7192 - protein, 138 aa, Unknown
  Sequence found in Organisms: Phaseolus vulgaris, Vigna unguiculata, Glycyrrhiza uralensis
MSGEEEENAAELKIGDEFLKAKCLMNCEVSLILEHKYEQLQQTSDDPMNQVSQVFEKSLQYVKRFSRYKNPDAVRQVREILARYQLAEFELCVLGNLCPETVEEAIAMVPSIKTRGRAQDDEAIEKMLNDLSLIKKFE

SEQ ID NO: 7193 - protein, 138 aa, Manihot esculenta
MSGEEEENASELKIGDEFLKAKCLMNCEVALILEHKYEQLQQMSNDPMNQVSQVFEKSLQYVKRFSRYKNPDAVRQVREILSRYQLAEFELCVLGNLCPETVEEAIAMVPSIKTKGRAHDDEAIEKMLNDLSLIKKFE

SEQ ID NO: 7194 - protein, 138 aa, Ricinus communis
MSGEEEENASELKIGDEFLKAKCLMNCEVALILEHKYEQLQQMSNDPMNQVSQVFEKSLQYVKRFSRYKNPDAVRQVREILSRYQLAEFELCVLGNLCPETVEEAIAMVPSIKTKGRAHDDEAIEKMLTDLSMIKKFE

SEQ ID NO: 7195 - protein, 138 aa, Unknown
  Sequence found in Organisms: Citrus clementina, Citrus sinensis
MSGEEEENAAELKIGDEFLKAKCLMNCEVAIILDHKYEQLQQTSDDPMNQVSQVFEKSLQYVKRFSRYKNPDAVRQVREILSRYQLAEFELCVLGNLCPETVEEAIAMVPSIKTRGRAHDDEAIEKMLNDLSLIKKFE

SEQ ID NO: 7196 - protein, 138 aa, Coffea canephora
MSGEEEENAAELKIGDEFLKAKCLMNCEVSLILEHKYEQLQQMSEDPMNQMSQVFEKSLQYVKRFSRYKNPDSVRQVREILSRYQLAEFELCVLGNLCPETVEEAIAMVPSIKNRGRALDDDAIEKMLNDLSLVKKFE

SEQ ID NO: 7197 - protein, 138 aa, Cyamopsis tetragonoloba
MSGEEEENAAELKIGDEFLKAKCLMNCEVALILEHKYEQLQQTSDDAVNQISQVFEKSLQYVKRFSRYKNPDAVRQVREILARYQLTEFELCVLGNLCPETVEEAIAMVPSIKTRGRAQDDEAIEKMLNDLSLIKKFE

SEQ ID NO: 7198 - protein, 138 aa, Unknown
  Sequence found in Organisms: Lotus japonicus, Trigonella foenum-graecum
MSGEEEENAAELKIGDEFLKAKCLMNCEVSLILEHKYEQLQQSSDDPMNQVSQVFEKSLQYVKRFSRYKNPDAVRQVREILARYQLAEFELCVLGNLCPETVEEAIAMVPSIKTRGRAQDDEAIEKMLNDLSLIKKFE

SEQ ID NO: 7199 - protein, 138 aa, Glycine max
MSGEEEENAAELKIGDEFLKAKCLMNCEVSLILEHKYEQLQQTSDDPMNQVSQVFEKSLQYVKRFSRYKNPDAVRQVREILARYQLAEFELCVLGNLCPETVEEAIAMVPSIKSRGRAQDDEAIEKMLNDLSLIKKFE

SEQ ID NO: 7200 - protein, 138 aa, Cicer arietinum
MSGEEEENAAELKIGDEFLKAKCLMNCEVSLILDHKYEQLQQSSDDPMNQVSQVFEKSLQYVKRFSRYKNPDAVRQVREILARYQLAEFELCVLGNLCPETVEEAIAMVPSIKTRGRAQDDEAIEKMLNDLSLIKKFE

SEQ ID NO: 7201 - protein, 136 aa, Bruguiera gymnorhiza
MSGEEEENAAELKIGDEFLKAKCLMNCEVALILEHKYEQLQQMSDDPMNQVSQVFEKSLQYVKRFSRYKNPDAVRQVREILSRYQLAEFELCVLGNLCPETVEEAIAMVPSIKSKGRAHDDEAVEKMLNDLSLIKK

SEQ ID NO: 7202 - protein, 138 aa, Unknown
  Sequence found in Organisms: Gossypium hirsutum, Gossypium raimondii, Heritiera littoralis
MSGEEEENAAELKIGEEFLKAKCLMNCEVALILEHKYEQLQQMSDDPMNQVSQVFEKSLQYVKRFSRYKNPDAVRQVREILSRYQLAEFELCVLGNLCPETVEEAIAMVPSIKTKGRAHDDDAIERMLNDLSLIKKFE

SEQ ID NO: 7203 - protein, 138 aa, Cucurbita pepo
MSGEEEENAAELKIGDEFLKAKCLMNCEVSLILEHKYEQLQQMSEDPTNQVSQVFEKSLQYVKRFSRYKNPDAVRQVREILSRYQLAEFELCVLGNLCPETVEEAISMVPSLKTKGRAHDDEAIEKMLNDLSLIKKFE

SEQ ID NO: 7204 - protein, 138 aa, Unknown
  Sequence found in Organisms: Fraxinus spp, Olea europaea
MSGEEEENAAELKIPDEFLKAKCLMNCEVALILEHKYEQLQQMSEDPMNQISQVFEKSLQYVKRFSRYKNPDAVRQVREILSRYQLAEFELSVLGNLCPETVEEALAMVPSIKTRGRAHDDDAIEKMLNDLSLIKKFE

SEQ ID NO: 7205 - protein, 138 aa, Carpinus betulus
MSAEEEENATELKIGDEFLKAKCLMNCEVALILEHKYEQLQQMSEDPLNQVSQVFEKSLQYVKRFSRYKNPDAVRQVREILSRYQLAEFELCVLGNLCPETVEEAIAMVPSIKTKGRAHDDEAIEKMLNDLSLIKKFE

SEQ ID NO: 7206 - protein, 138 aa, Medicago truncatula
MSGEEEENAAELKIGDEFLKAKCLMNCEVSLILEHKYEQLQQSSDDAMNQVSQVFEKSLQYVKRFSRYKNPDAVRQVREILARYQLAEFELCVLGNLCPETVEEAIAMVPSIKTRGRAQDDEAIEKMLNDLSLIKKFE

SEQ ID NO: 7207 - protein, 138 aa, Momordica charantia
MSGEEEENAAELKIGDEFLKAKCLMNCEVSLILEHKYEQLQQMSEDPMNQVSQVFEKSLQYVKRFSRYKNPDAVRQVREILSRYQLAEFELCVLGNLCPETVEEAIAMVPSLKTKGRAHDDEAIEKMLNDLSLIKKFE

SEQ ID NO: 7208 - protein, 138 aa, Arachis hypogaea
MSGEEEENAAELKIGDDFLKAKCLMNCEVSLILEHKYEQLQQTSDDPMNQVSQVFEKSLQYVKRFSRYKNPDAVRQVREILARYQLAEFELCVLGNLCPETVEEAIAMVPSIKTRGRAQDDEAIEKMLNDLSLIKKFE

SEQ ID NO: 7209 - protein, 138 aa, Petunia hybrida
MSGEEEENAAELKIGEEFLKAKCLMNSEVALILEHKYEQIQQMSDDPSNQVSQVFEKSLQYVKLFSRYKNPDAVRQVREILSRYQLAEFELCVLGNLCPYTVEEAIARVPSIKNRGRTLDGEAIKKMLNDLSLIKKFE

SEQ ID NO: 7210 - protein, 138 aa, Lippia dulcis
MSAEEEENAAELKIPDEFLKAKCLMNCEVSLILEHKYEQLQQMADDPMNQMSQVFEKSLQYVKRFSRYKNPDAVRQVREILSRYQLAEFELCVLGNLCPETVEEAIAMVPSIKTRGRAHDDEAIEKMLNDLSLIKKFE

SEQ ID NO: 7211 - protein, 138 aa, Helianthus annuus
MSGEEEENAAELKIGDEFLKAKCLMNCEVSLILEHKYEQLQQMSEDPTNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7212 - protein, 138 aa, Juglans hindsii x Juglans regia
MSGEEEENAAELKIGDEFLKAKCLMNCEVALILEHKYEQLQQMSDDAANHVSQVFEKSQQYVKRFSRYKNPDAVRQVREILSRYQLAEFELCVLGNLCPETVEEAIAMVPSIKTKGRAHDDEAIEKMLNDLSLIKKFE

SEQ ID NO: 7213 - protein, 114 aa, Rhizophora mangle
MNCEVSLILEHKYEQLQQMSDDPMNQVSQVFEKSLQYVKRFSRYKNPDAVRQVREILSRYQLAEFELCVLGNLCPETVEEAIAMVPSIKSKGRAHDDEAIEKMLNDLSLIKRFE

SEQ ID NO: 7214 - protein, 138 aa, Theobroma cacao
MSGEEEENAAELKIGEEFLKAKCLMNCEVALILEHKYEQLQQMSEDPMNQVSQVFEKSLQYVKRFSRYKNPDAVRQVREILSRYQLAEFELCVLGNLCPETVEEAIAMVPSIKTKGRAHDDDAIERMLNDLSLIKKFE

SEQ ID NO: 7215 - protein, 138 aa, Catharanthus roseus
MSAEEEENAAELKIGDEFLKAKCLMNCEVALILEHKYEQLQQTSDDPMNQMSQVFEKSLHYVKRFSRYKNPDSVRQVREILSRHQLAEFELCVLGNLCPETVEEAIAMVPSIKNRGRALDDEAIEKMLNDLSLVKQFE

SEQ ID NO: 7216 - protein, 138 aa, Cichorium intybus
MSGEEEENAAELKIGDEFLKAKCLMNCEVSLILEHKYEQLQQMSEDPLNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7217 - protein, 138 aa, Cucurbita pepo
MSGEEEENAAELKIGDEFLKAKCLMNCEVSLILEHKYEQLQQMSEDPMNQVSQVFEKSLQYVKRFSRYKNPDAVRQVREILSRYQLAEFELCVLGNLCPETVEEAIAMVPSLKAKGRVHDDEAIEKMLNDLSLIKKFE

SEQ ID NO: 7218 - protein, 138 aa, Euonymus alatus
MSGEEEENAAELKIGDEFLKAKCLMNCEVALILEHKYEQLQQMSGDPLNQISQVFEKSLQYVKRFSRYKNPDAVRQVREILSRYQLAEFELCVLGNLCPETVEEATVMVPSIKTKGRDHDDEAIEKMLNDLSLVKKFE

SEQ ID NO: 7219 - protein, 138 aa, Unknown
  Sequence found in Organisms: Euphorbia peplus, Euphorbia esula
MSGEEEENAAELKIGDEFLKAKCLMNCEVSLILEHKYEQLQQMSEDPMHQISQVFEKSLQYVKRFSRYKNPDAVRQVREILSRYQLAEFELCVLGNLCPETVEEAIAMVPSIKAKGRVHDDEAIEKMLNDLSLIKRFE

SEQ ID NO: 7220 - protein, 138 aa, Flaveria ramosissima
MSGEEEENAAELKIGDEFLKAKCLMNCEVALILEHKYEQLQQMSEDPMNQMSQVFEKSLQYVKRFSRYKNPDAVRQVRELLSGYQLAEFELCVLGNLCPETVEEAIAMVPSIKSRGRGHDDEAIEKMLNDMSLIKKFE

SEQ ID NO: 7221 - protein, 138 aa, Guizotia abyssinica
MSGEEEENAAELKIGDEFLKAKCLMNCEVALILDHKYEQLQQMSEDPMNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7222 - protein, 138 aa, Tropaeolum majus
MSGEEEENAAELKIGDEFLRAKCLMNCEVSLILEHKYEQLQQTSDDPLNQVSQVFEKSLQYVKRFSRYKNPDAVRQVREILSRYQLAEFELCVLGNLCPETVEEAIAMVPSIKTKGRAHDDEAIEKMLNDLSLIKRFE

SEQ ID NO: 7223 - protein, 138 aa, Helianthus annuus
MSGEEEENAAELKIGDEFLKAKCLMNCEVSLILEHKYEQLQQMSEDPMNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7224 - protein, 138 aa, Citrullus lanatus
MSGEEEENAAELKIGDEFLKAKCLMNCEVSLILEHKYEQLQQMSEDPTNQVSQVFEKSLQYVKRFSRYKNPDAVRQVREILSRYQLAEFELCVLGNLCPETVEEAIAMVPSLKTKGRVHDDEAIEKMLNDLSLIKRFE

SEQ ID NO: 7225 - protein, 139 aa, Aquilegia formosa
MSGQEEEENAAELKIGDEFLKAKCLMNCEVALILDRKYEQLQQMSDDPMNQVSQVFEKSLQYVKRFSRYTNPDAVRQVREILSRYQLAEFELCVLGNLCPETVEEAIAMVPSIKSRGRTHEDEAIEKMLNDLSLIKKFE

SEQ ID NO: 7226 - protein, 138 aa, Ambrosia trifida
MSGEEEENAAELKIGDEFLKAKCLMNCEVSLILEHKYEQLQQMSEDPMNQVSQVFEKSLQYVKRFSRYKNPDAVRQVRELLSGYQLAEFELCVLGNLCPETVEEAIAMVPSIKSRGRGHDDEAIEKMLNDMSLIKKFE

SEQ ID NO: 7227 - protein, 138 aa, Vaccinium corymbosum
MSGEEEENAAELKIGDEFLKAKCLMNCEVALILERKYEQLQHMADDPMNQVSQVFEKSLQYVKRFSRYKNPDAVRQAREILSRYQLAEFELCVLGNLSPETVEEAIAIVPSMKSRGRTLDEEAIEKMLNDLSMIKKFD

SEQ ID NO: 7228 - protein, 138 aa, Unknown
  Sequence found in Organisms: Cucumis sativus, Cucumis melo
MSGEEEENAAELKIGDEFLKAKCLMNCEVSLILEHKYEQLQQMSEDPTNQVSQVFEKSLQYVKRFSRYKNPDAVRQVREVLSRYQLAEFELCVLGNLCPETVEEAIAMVPSLKTKGRVHDDEAIEKMLNDLSLIKRFE

SEQ ID NO: 7229 - protein, 138 aa, Lactuca sativa
MSGEEEENAAELKIGDEFLKAKCLMNCEVSLILEHKYEQLQQMSEDPLNQVSQVFEKSLQYVKRFSRYKNPDAVRQVRELLSRQQLAEFELCVLGNLCPETVEEAIAMVPSIKSRGRGHDDEAIEKMLNDMSLIKKFE

SEQ ID NO: 7230 - protein, 138 aa, Nuphar advena
  misc_feature (76)..(76): Xaa can be any naturally occurring amino acid
MSGEEEENAAELKIGEEFLKAKCLMNCEVALILDHKYEQLQQMSDDPTTQISQVFEKSLQYVKRFSRYKNPDAVRXVREILSRYQLAEFELCVLGNLCPETVEEAIAMVPSIKTKGRTHDDDAIEKMLNDLALIKKFE

SEQ ID NO: 7231 - protein, 138 aa, Helianthus annuus
MSGEEKENAAELKIGDEFLKAKCLMNCEVSLILEHKYEQLQQMSEDPMNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7232 - protein, 138 aa, Helianthus annuus
MSEEEEENAAELKIGDEFLKAKCLMNCEVSLILEHKYEQLQQMSEDPMNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7233 - protein, 138 aa, Tragopogon dubius
MSGEEEENAADLKIGDEFLKAKCLMNCEVSLILEHKYEQLQQMSEDPLNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7234 - protein, 138 aa, Citrullus lanatus
MSGEEEENAAELKIGDEFLKAKCLMNCEVSLILEHKYEQLQQMAEDPTNQISQVFEKSLQYVKRFSRYKNPDAVRQVREILSRYQLAEFELCVLGNLCPETVEEAISIVPSLKTKGRVHDDEAIEKMLNDLSLIKKFE

SEQ ID NO: 7235 - protein, 140 aa, Valeriana officinalis
MSAAGEEEENAAELKIGDEFLKAKCLMNCEVALILEHKYEQLQQTSEDPMNQVSQVFEKSLQYVKRFSRYKNPDAVRQVREILSRYQLAEFELCVLGNLCPETVEEAIAMVPSIKSRGRGHDDEAIEKMLNDLSLIKKFE

SEQ ID NO: 7236 - protein, 138 aa, Linum usitatissimum
MSGEEEENAAELKIGDEFLKAKCLMNCEVSLILEHKYEQLQQMSDDATNQMSQVFEKSLQYVKRFSRYKNPDAVRQVREILSRYQLAEFELCVLGNLCPETVEEATTMVPSLKTKDRSLDDDAIEKMLNDLSLIKKFE

SEQ ID NO: 7237 - protein, 147 aa, Antirrhinum majus
  misc_feature (9)..(9): Xaa can be any naturally occurring amino acid
  misc_feature (15)..(15): Xaa can be any naturally occurring amino acid
  misc_feature (17)..(17): Xaa can be any naturally occurring amino acid
FFFVTVYHXCPVKKXFXAAELKIPDEFLKAKCLMNCEVSLILEHKYEQLQQMADDPMNQMSQVFEKSLQYVKRFSRYKNPDAVRQVREILSRYKLAEFELCVLGNLCPETVEEAIAMVPSIKTRGRSHDDEAIEKMLNDLSLIKKFE

SEQ ID NO: 7238 - protein, 139 aa, Amborella trichopoda
MSGEEEENAAELKIGEEFLKAKCLMNCEVALILDHKYEQLQQMSDDPSNQISQVFEKSLQYVKRFSRYKNPDAVRQVREVLSRNQLAEFELCVLGNLCPETVEEAIAMVPSIKAKGRSNNDDDAIEKMLNDLALIKKFE

SEQ ID NO: 7239 - protein, 140 aa, Taraxacum officinale
MSGAAEEEENAADLKIGDEFLKAKCLMNCEVSLILEHKYEQLQQMSEDPLNQVSQVFEKSLQYVKRFSRYKNPDAVRQVRELLSRYQLAEFELCVLGNLCPETVEEAIAMVPSIKSRGRGHDDEAIEKMLNDMSLIKKFE

SEQ ID NO: 7240 - protein, 138 aa, Malus domestica
MSGEEEENAAELKIGDEFLKAKCLMNCEVSLILEHKFEQLQQMSDDPRNQISQVFEKSLQYVKRFSRYKNPDAVKQVREILSRYQLTEFELCVLGNLCPETVEEAIAMVPSIKAKGRVHDDDAIDKMLNDLALIKKFE

SEQ ID NO: 7241 - protein, 138 aa, Artemisia annua
MSGEEEENAAELKIGDEFLKAKCLMNCEVSLILDHKLEQLQAMSDDPSNQVSQVFEKSLQYVKRFSRYKNPDAVRQVRELLSRHQLAEFELCVLGNLCPETVEEAIAMVPSIKSRGRGHDDEAIEKMLNDMSLIKKFE

SEQ ID NO: 7242 - protein, 138 aa, Cleome gynandra
MSGEEEENAAELKIGDEFLKAKCLMNCEVALILEHKYEQLQQVSEDPMNQVSQVFEKSLQYVKRFSRYKNPDAVRQVREILSRYQLTEFELCVLGNLCPETVEEAVAMVPSLKTKGRVHDDEAIEKMLNDLSLIKRFE

SEQ ID NO: 7243 - protein, 138 aa, Cleome spinosa
MSGEEEENAAELKIGDEFLKAKCLMNCEVALILEHKYEQLQQISEDPMNQVSQVFEKSLQYVKRFSRYKNPDAVRQVREILSRYQLTEFELCVLGNLCPETVEEAVAMVPSLKTKGRVHDDEAIEKMLNDLSLIKRFE

SEQ ID NO: 7244 - protein, 138 aa, Euphorbia peplus
MSELEEENAADLKIGDEFLKAKCLMNCEVSLILEHKYEQLQQMSDDPMLQISQVFEKSLQYVKRFSRYKNPDAVRQVREILSRYQLAEFELCVLGNLCPETLEEAIAMVPSIKAKGRIHDDEAIEKMLNDLSLIKRFE

SEQ ID NO: 7245 - protein, 138 aa, Linum usitatissimum
MSGEEEENAAELKIGDEFLKAKCLMNCEVSLILEHKYEQLQQMSDDASNQMSQVFEKSLQYVKRFSRYKNPDAVRQVREILSRYQLAEFELCVLGNLCPETVEEATTMVPSLKTKDRSLDDDAIEKMLNDLSLIKKFE

SEQ ID NO: 7246 - protein, 138 aa, Elaeis guineensis
MSGEEEENAAELKIGEEFLKAKCLMNCEVALILDRKYEQLQQLSDDPTNQISQVFEKSMQYVKRFSRYKNQDAVRQVREILSRYRLAEFELCVLGNLCPETVEEAIAMVPSIKSKGRIHEDDAIEKMLNDLSLIKKFE

SEQ ID NO: 7247 - protein, 138 aa, Prunus persica
MSGEEEENAAELKIGDEFLKAKCLMNCEVALILEHKYDQLQQMSDDPRNQVSQVFEKSLQYVKRFSRYKNPDAVKQVREILSRYQLTEFELCVLGNLCPETVEEAIAMVPSIKAKGRVHDDDAIDKMLNDLALIKKFE

SEQ ID NO: 7248 - protein, 138 aa, Rosa hybrid cultivar
MSGEEEENAAELKIGDEFLKAKCLMNCEVSLILEHKFEQLQQMSDDPRNQVSQVFEKSLQYVKRFSRYKNPDAVKQVREILSRYQLTEFELCVLGNLCPETVEEAIAMVPSIKAKGRVHDDEAIDKMLNDLALIKKFE

SEQ ID NO: 7249 - protein, 90 aa, Chelidonium majus
MSNDPMNQVSQVFEKSLQYVKRFSRYKNPDAVRQVREILSRYQLAEFELCVLGNLCPETVEEAIAMVPSIKTKGRAHEDEAIEKMLNDLP

SEQ ID NO: 7250 - protein, 98 aa, Primula obconica
MINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 7251 - protein, 138 aa, Musa acuminata
MSGEEEENAAELKIGEEFLKAKCLMNCEVARILDHKYDQLQQTSDDPTNQISQVFEKSMQYVKRFSRYKNPDAVRQVREVLSRYKLAEFELCVLGNLCPETVEEAIAIVPSIKSKGRMLEDDAIEKMLHDLSLIKKFE

SEQ ID NO: 7252 - protein, 138 aa, Eschscholzia californica
MSGEEEENAAELKIGEEFLKAKCLMNCEVALILDRKYEQLQEMSSDPMNQVSQVFEKSLQYVKRFSRYKNPDTVRQVREILSRHQLAEFELCVLGNLCPETVEEAIAMVPSIKTKGRAHDDDAIEKMLNDLSLIKKFE

SEQ ID NO: 7253 - protein, 138 aa, Mimulus guttatus
MSGEEEENAAELKIPDEFLKAKCLMNSEVAIILEHKYEQLQQRAEDPMNQMSQVFEKSLQYVKRFSRYKNNDAVRQVREILSRHQLAEFELCVLGNLCPETVEEAIAMVPSIKTRGRAHDDEAIERMLNDLSLIKKFE

SEQ ID NO: 7254 - protein, 140 aa, Unknown
  Sequence found in Organisms: Centaurea maculosa, Cirsium arvense
MSAPGEEEENAAELKIGDEFLKAKCLMNCEVSLILEHKYEQLQQMSEDPTNQVSQVFEKSLQYVKRFSRYKNPDAVKQVRELLSRYQLAEFELCVLGNLCPETAEEAIAMVPSIKSRGRVHDDEAIDKMLNDMTLIKKFE

SEQ ID NO: 7255 - protein, 120 aa, Olea europaea
MSGEEEENAAELKIPDEFLKAKCLMNCEVALILEHKYEQLQQMSEDPMNQISQVFEKSLQYVKRFSRYKNPDAVRQVREILSRYQLAEFESFCTWEPLPRDGGGSSCHGPIYQDSRTSTR

SEQ ID NO: 7256 - protein, 138 aa, Aristolochia fimbriata
MSGEEEENAAELKIGEEFLKAKCLMNCEVALILDRKYEQLQQMSEDPMNQISQVFEKSLQYVKRFSRYKNPDAVRQVREILSRHQLAEFELCVLGNLSPETVEEAIAMVPSLKSRERFHNDEAIETMLNDLSLIKKFE

SEQ ID NO: 7257 - protein, 138 aa, Bupleurum chinense
MSAEEEENASELKIGEEFLKAKCLMNCEVAIILDHRYENLQQTSEDPMNQMSQVFEKSLQYVKRFSRYKNPDAVRQVREILSRYQLAEFELCVLGNLCPETVEEAIAMVPSIRSRGRGLDDEAIEKMLNDLSLIKKFE

SEQ ID NO: 7258 - protein, 138 aa, Cucumis sativus
MSGEEEENAAELKIGDEFLKAKCLMNCEVSLILEHKYEQLQQRAEDPTNQVSQVFEKSLQYVKRFSRYKNPDAVRQVREILSRYQLAEFELCVLGNLCPETVEEATSIVPSLKTKGRVHEDEAIEKMLNDLSLIKKFE

SEQ ID NO: 7259 - protein, 137 aa, Fagopyrum esculentum
MAEEEENAAELKIGDEFLKAKCLMNCEVALILERKYEQLQQMSEDPANQVSQVFEKSMQYVKRFSRYQNPDAVRQVREILSRYQLAEFELCVLGNLCPETVEEAIAMVPSIKTRGRALDDNAIQKMVDDLALIKKFE

SEQ ID NO: 7260 - protein, 138 aa, Utricularia gibba
MSAEEDENAAELKIPDEFLKAKCLMNCEVALILERKNDQLQQMADDYMNQNSQVFEKSLQYVKRFSRYKNPDAVRQVREILSRYKLAEFELCVLGNLCPETVEEAIAMVPSIKAKGRAHDDDAIEKMLNDLSLIKKFE

SEQ ID NO: 7261 - protein, 141 aa, Senecio madagascariensis
MSGAAGEEEENAAELKIGDEFLKAKCLMNCEVALILEHKYDQLQQMSEDPMNQVSQVFEKSLQYVKRFSRYKNPDAVRQVRELLSRYQLAEFELCVLGNLCPETVEEAIAMVPSIKSRGRGHDDEAIDKMLNDMSLIKKFE

SEQ ID NO: 7262 - protein, 140 aa, Centaurea maculosa
MSAPGEEEENAAELKIGDEFLKAKCLMNCEVSLILEHKYEQLQQMSEDPTNQVSQVFEKSLQYVKRFSRYKNPDAVKQVRELLSRYQLAEFELCVLGNLCPETAEEAIAMVPSIKSRGRVHDDEVIDKMLNDMTLIKKFE

SEQ ID NO: 7263 - protein, 138 aa, Arabidopsis lyrata
MSGEEEENAAELKIGDEFLKAKCLMNCEVSLILEHKFEQLQQVSEDPMNQVSQVFEKSLQYVKRFSRYKNPDAVRQVREILSRHQLTEFELCVLGNLCPETVEEAVAMVPSLKTKGRAHDDEAIEKMLNDLSLVKRFE

SEQ ID NO: 7264 - protein, 138 aa, Arabidopsis thaliana
MSGEEEENAAELKIGDEFLKAKCLMNCEVSLILEHKFEQLQQISEDPMNQVSQVFEKSLQYVKRFSRYKNPDAVRQVREILSRHQLTEFELCVLGNLCPETVEEAVAMVPSLKTKGRAHDDEAIEKMLNDLSLVKRFE

SEQ ID NO: 7265 - protein, 137 aa, Fagopyrum esculentum
MAEEEENAAELKIGEEFLKAKCLMNCEVALILERKYEQLQQMSEDPSNQVSQVFEKSMQYVKRFSRYQNPDAVRQVREILSRYQLAEFELCVLGNLCPETVEEAIAMVPSIKTRGRALDDNAIQKMVDDLALIKKFE

SEQ ID NO: 7266 - protein, 130 aa, Sesamum indicum
MSVEEEENAAELKIPDEFLKAKCLMNCEVALILEHKYEQLQQMADDPMNQMSQVFEKSLQYVKRFSRYKNPDAVRQVREILSRYQLAEFELCVLGNLCPETVEEAIAMVPSIKTRGRAHDDEAIEKMLND

SEQ ID NO: 7267 - protein, 139 aa, Euphorbia peplus
QNVWREEENAAELKIGDEFLKAKCLMNCEVSLILEHKYEQLQQTSEDPMHQISQVFEKSLQYVRRFSRYKNPDAVRQVREILSRYQLAEFELCVLGNLCPETVEEAIAMVPSIKAKGRVHDDEAIEKMLHDLSLIKRFE

SEQ ID NO: 7268 - protein, 138 aa, Unknown
  Sequence found in Organisms: Brassica napus, Brassica rapa, Raphanus sativus
MSGEEEENAAELKIGDEFLKAKCLMNCEVSLILEHKYEQLQQVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7269 - protein, 129 aa, Humulus lupulus
AELKIGDEFLKAKCLMNCEVALILERKYDQLQQMSDDPLNQVSQVFEKSLQYVKRFSRYKNPDAVRQVREILSRYQLAEFELCVLGNLCPETVEEAIAMVPSIKTKGRAHDDEAIEKMLNDLSLIKKFE

SEQ ID NO: 7270 - protein, 138 aa, Eutrema parvulum
MSGEEEENAAELKIGDEFLKAKCLMNCEVSLILEHKYEQLQQVSEDPMNQVSQVFEKSLQYVKRFSRYKNPDAVRQVREILSRHQLTEFELCVLGNLCPETAEEAVAMVPSLKTKGRAHNDEAIEKMLNDLSLVKRFE

SEQ ID NO: 7271 - protein, 140 aa, Cynara scolymus
MSAAGEEEENAADLKIGDEFLKAKCLMNCEVSLILERKYDQLQQMSEDPMNQVSQVFEKSLQYVKRFSRYKNPDAVRQVRELLSGYQLAEFELCVLGNLCPETVEEAIAMVPSIKSRGRVHDDEAIEKMLNDMSLIKKFE

SEQ ID NO: 7272 - protein, 139 aa, Raphanus sativus
MSGEEEEENAAELKIGDEFLKAKCLMNCEVSLILEHKYEQLQQVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7273 - protein, 88 aa, Curcuma longa
MSGEEEENAAELKIGDEFLKAKCLMNCEVARILDHKYDQLQQMSTDPTNQISQVSEKSMQYVKRFSNYKHRCSEASTRSYKQIQISGV

SEQ ID NO: 7274 - protein, 138 aa, Aristolochia fimbriata
MSGEEEENAAELKIGDEFLKAKCLMNCEVSLILERRYEQLQQMSDEHLNQVSQVFEKSQQYVKRFSRYKNPDAVRQVREILSRHKLAEFELCVLGNLSPETVEEAIAMVPSLKTKGRFQNDEAIETMLNDLSLIKKFE

SEQ ID NO: 7275 - protein, 138 aa, Brassica juncea
MSGEEEENAAELKIGDEFLKAKCLMNCEVSLILEHKFEQLQQVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7276 - protein, 138 aa, Unknown
  Sequence found in Organisms: Brassica juncea, Brassica oleracea
MSGEEEENAAELKIGDEFLKAKCLMNCEVSLILEHKYEQLQLVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7277 - protein, 138 aa, Brassica napus
MSGEEEENAAELKIGDEFLKAKCLMNCEVSLILEHKYEQLQHVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7278 - protein, 138 aa, Phalaenopsis aphrodite
MSAEEEENAAELKIGEEFLKAKCLMNCEVALILDRRLEQLQQMSDDPTNQMSQVFEKSHQYVKRFSRYKNQDAVKQVREILSRNKLAEFELCVLGNLCPETVEEAIAMVPSLKTKGRSLEDDAIEKMLNDLSLIKKFE

SEQ ID NO: 7279 - protein, 144 aa, Salvia sclarea
MSTEEEENAAELKIPDEFLKAKCLMNCEVSLILEHKYEQLQQMADDPLNQMSQVFEKSLQYVKRFSRYKNPDAVRQVREILSRYQLAEFELCVLGNLCPETVEEAIAMVPSIKTRGRAHDDEAIEKMLNDLSLDQKVRVVFFPL

SEQ ID NO: 7280 - protein, 138 aa, Fragaria vesca
MSGEEEENAAELKIGDEFLKAKCLMNCEVSLILEHKFEQLQQMSDDPRNQVSQVFEKSLQYVKRFSRYKNADAVKQVREILSRYQLTEFELCVLGNLCPETVEEAIAMVPSIKAKGRVHDDEVIDKMLNDIAMIKKFD

SEQ ID NO: 7281 - protein, 140 aa, Carthamus tinctorius
MSAAGEEEENAAELKIGDEFLKAKCLMNCEVSLILEHKYEQLQQMSEDPMNQVSQVFEKSLQYVKRFSRYKNPDAVKQVRELLSGYQLAEFELCVLGNLCPETAEEAIAMVPSIKSRGRVHDDEAIDKMLNDMTLIKKFE

SEQ ID NO: 7282 - protein, 139 aa, Brassica napus
MSGEEEEENAAELKIGDEFLKAKCLMNCEVSLILEHKYEQLQLVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7283 - protein, 140 aa, Unknown
  Sequence found in Organisms: Brassica napus, Brassica rapa
MSGVGEEEENAAELKIGDEFLKAKCLMNCEVSLILEHKYEQLQLVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7284 - protein, 136 aa, Brassica napus
GEEEENAAELKIGDEFLKAKCLMNCEVSLILEHKYEQLQLVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 7285 - protein, 127 aa, Fraxinus spp
MSGEEEENAAELKIPDEFLKAKCLMNCEVALILEHKYEQLQQMSEDPMNQISQVFEKSLQYVKRFSRYKNPDAVRQVREILSRYQLAEFELSVLGNLCPETVEEALAMVPSIKTRGRAHDDDAIEKC

SEQ ID NO: 7286 - protein, 138 aa, Eutrema halophilum
MSGEEEENAAELKIGDEFLKAKCLMNCEVSLILEHKYEQLQQVSEDPMNQVSQVFEKSLQYVKRFSRYKNPDAVRQVREILSRHQLTEFELCVLGNLCPESAEEAVAMVPSLRTKGRTHDDDAIGKMLVDLSLVKKFE

SEQ ID NO: 7287 - protein, 127 aa, Lippia dulcis
MSAEEEENAAELKIPDEFLKAKCLMNSEVALILDHKYEQLQQMGEDPMNQMSQVFEKSLQYVKRFSRYKNPDAVRQVREILSRYQLAEFELCVLGNLCPETVEEAIATVPSIKTRGRAHDDDAIEKC

SEQ ID NO: 7288 - protein, 140 aa, Cirsium arvense
MSAAGEEEENAAELKIGEEFLKAKCLMNCEVSLILEHKYEQLQQMSEDPMNQVSQVFEKSLQYVKRFSRYKNPDAVRQVRDLLTGYQLAEFEVCVLGNLCPETAEEAVAMVPSIKSRGRVHDNEAIEKMLNDMSLIKKFE

SEQ ID NO: 7289 - protein, 96 aa, Catharanthus roseus
MSEDPMNQMSQVFEKSLQYVKRFSRYKNPDSVRQVREILSRYQLAEFELCVLGNLCPETVEEAIAMVPSIKNRGRALDDEAIEKMLNDLSLVKKFE

SEQ ID NO: 7290 - protein, 140 aa, Cycas rumphii
MASTSEEEENAAELKIGEEFLKAKCLMNSEVALILERKYEQLQQMSDDPSTQISQVFEKSLQYVKRFSRYKNPDAVKQVREVLSRNNLAEFELCVIGNLCPETVEEAKAMVPSIKAKGRMNDDEKIEKMLDDLARIKRFE

SEQ ID NO: 7291 - protein, 114 aa, Nicotiana benthamiana
MNCEVALILEHKYEQLQQMSEDPTNQISQVFEKSLQYVKRFSRYKNPDAVRQAREILSRYPLAEFELCVLGNLCPETVEEGIAMVPSIKNRGHALDEEAIEKMLTDLSLIKKFE

SEQ ID NO: 7292 - protein, 144 aa, Unknown
  Sequence found in Organisms: Solanum tuberosum, Solanum phureja
MADDDYDMDGGYVDEPMDPEPDEGAEIEEDNGNNEDVPDPLMGEGEEKPEQQEPVERPRKTSKFMTKYERARILGTRALQISMNAPVMVELEGETDPLEIAMKELRERKIPFTIRRYLPDGSYEDWGVDELIVEDSWKRQVGGT

SEQ ID NO: 7293 - protein, 143 aa, Unknown
  Sequence found in Organisms: Nicotiana benthamiana, Nicotiana tabacum
MADDDYDMDGGYVDEPIEPEPDEGAEIEEDNGNNEDIPDPLLGEGEEKTEQEPVERPRKTSKYMTKYERARILGTRALQISMNAPVMVELEGETDPLEIAMKELRERKIPFTIRRYLPDGSYEDWGVDELIVEDSWKRQVGGT

SEQ ID NO: 7294 - protein, 143 aa, Capsicum annuum
MADDDYEMDGGYMDEPMDPEPEEGAEIEEDNANNDDIPDPLLGEGAEKTEQEPVERPRKTSKFMTKYERARILGTRALQISMNAPVMVELEGETDPLEIAMKELRERKIPFTIRRYLPDGSYEDWGVDELIVEDSWKRQVGGT

SEQ ID NO: 7295 - protein, 144 aa, Solanum melongena
MADDDYEMDGGYLDEPMEPEPEEGAEIEEDNVNNDDIPDPLLGEGEDKTELQEPVERPRKTSKFMTKYERARILGTRALQISMNAPVMVELEGETDPLEIAMKELRERKIPFTIRRYLPDGSFEDWGVDELIVEDSWKRQVGGT

SEQ ID NO: 7296 - protein, 143 aa, Nicotiana tabacum
  misc_feature (36)..(36): Xaa can be any naturally occurring amino acid
MADEDYDMDGGYEDEPIEPEPDEGAEVEEDNVNNEXVPDPLLGEGEEKPEQEPVERPRKTSKYMTKYERARILGTRALQISMNAPVMVELEGETDPLEIAMKELREKKIPFTIRRYLPDGSYEDWGVDELIVEDTWKRQVGGA

SEQ ID NO: 7297 - protein, 143 aa, Mimulus guttatus
MADEDYEMDGGYEDEPMEPELDEGVEVEEDNENPDDVPDPIEGDGEEKQEQEPVERPRKTSKYMTKYERARILGTRALQISMNAPVMVELEGETDPLEIAMKELRERKIPFTIRRYLPDGSYEDWGVDELIVEDSWKRQVGGN

SEQ ID NO: 7298 - protein, 142 aa, Orobanche aegyptiaca
MADEDYEMDGGYEDEPMDPDLDEEAELEEENNNEDAPDPIEGEGEEKQDQEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7299 - protein, 142 aa, Petunia hybrida
MADEEYDMDGGYEDEPIEPELDEGAEVEEDNGNEELPDPLLGEGEEKPEQEPVERPRKTSKYMTKYERARILGTRALQISMNAPVMVELEGETDPLEIAMKELREKKVPFTIRRYLPDGSYEDWGVDELIVEDSWKRQVGGA

SEQ ID NO: 7300 - protein, 142 aa, Orobanche aegyptiaca
MADEDYEMDGGYEDEPMDPELDEEAELEEENNNEDAPDPIEGEGEEKQDQEPIARPRKTSKYMTKYERARILGTRALQISMNAPVMVELEGETDPLEIAMKELRERKIPFTIRRYLPDGSYEDWGVDELIVEDSWKRQVGGD

SEQ ID NO: 7301 - protein, 142 aa, Triphysaria pusilla
MADEDYEMDGGYEDEPMDPEPDEGAELEEENLNEEAADPLEGEGEDKQEQEPVERPRKTSKYMTKYERARILGTRALQISMNAPVMVELEGETDPLEIAMKELRERKVPFTIRRYLPDGSYEDWGVDELIVEDSWKRQVGGN

SEQ ID NO: 7302 - protein, 143 aa, Olea europaea
MADEDYEMDGGYEDEPLDPEPDEGVEVEEENNNNEDAPDDILGEGEEKQEEVPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7303 - protein, 142 aa, Catharanthus roseus
MADEEYEMDGGYEDEPMEPEPDEGAEVEEENNNEDGPDPILGDTEEKQEEQPRERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7304 - protein, 143 aa, Fraxinus spp
MADEDYEMDGGYEDEPMEPEPDEGAEVEEENNNNEEAADAFEGEGEDKHEQEPAERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7305 - protein, 143 aa, Fraxinus spp
MADEDYEMDGGYEDEPIDPEPDEGVELEEENNNNEDAPDDIVGEGEEKQEEVPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7306 - protein, 141 aa, Olea europaea
MADEDYDMDGGYEDEPIEPEPDEGVELEEENNEDAPDDIVGEGEEKQEDEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7307 - protein, 141 aa, Olea europaea
MADEDYDMDGGYEDEPIEPEPDEGVELEEENNEDAPDDIVGEGEEKQEVEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7308 - protein, 143 aa, Lippia dulcis
MADEEYDMDGGYEDEPLEPELDEGAEIEEDINNNEEVPDPIEGEGDDKQEQEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7309 - protein, 143 aa, Sesamum indicum
MADEDYDMDGAYEDEPLEPEPDEGAEVEDENNNNEDGPDPIEGDGDEKQEQEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7310 - protein, 129 aa, Lippia dulcis
MADEDYDMDGGYEDEPPEPELDEGAEAEEDDAAAEDIPDALEGEGDEKQEQEGVERPRKTSKYMTKYERARILGTRALQISMNAPVMVELEGETDPLEIAMKELRERKIPFTIRRYLPDGSYEDWGVMN

SEQ ID NO: 7311 - protein, 140 aa, Sesamum indicum
MADEDYDMDGAYEDEPMEPEPDEGAEVEEENNNNEDGPDPVEGDGDEKQEQEPIERPRKTSKYMTKYERARILGTRALQISMNAPVMVELEGETDPLEIAMKELRERKIPFTIRRYLPDGSYEDWGVDELIVEDSWKRQV

SEQ ID NO: 7312 - protein, 142 aa, Triphysaria pusilla
MADEDYEMDGGYEDEPMDPELDEGAEVEEENPNEEAPDPIEGEGDDKQEQEAVERPRKTSKYMTKYERARILGTRALQISMNAPVMVELEGETDPLEIAMKELRERKIPFTIRRYLPDGSYEDWGVDELIVEDSWKRQVGGN

SEQ ID NO: 7313 - protein, 143 aa, Vaccinium corymbosum
MADDGDYDMDGGYEDEPIEPEPEEGAEEEADNENNDDAVDALLAEAEEKEGEPKERARKTSKYMTKYERARILGTRALQISMNAPVMVELEGETDPLEIAMKELRERKIPFTIRRYLPDGSYEDWGVDELIVEDSWKRQVGGD

SEQ ID NO: 7314 - protein, 143 aa, Vaccinium corymbosum
MADDGDYDMDGGYEDEPIEPEPEEGAEEEADNENNDDAVDALLAEAEEKEDEPIERARKTSKYMTKYERARILGTRALQISMNAPVMVELEGETDPLEIAMKELRERKIPFTIRRYLPDGSYEDWGVDELIVEDSWKRQVGGD

SEQ ID NO: 7315 - protein, 144 aa, Platanus occidentalis
MADEDYNDVDMGYEDEPPEPEVEEGAEEDVENNNNEDIPDPLLAEGEEKAEQVPIERPRKTSKFMTKYERARILGTRALQISMNAPVMVELEGETDPLEIAMKELRERKIPFTIRRYLPDGSYEDWGVDELIVEDSWKRQVGGD

SEQ ID NO: 7316 - protein, 144 aa, Platanus occidentalis
MADEDYNDVDLGYEDEPPEPEIEEGAEEDVDNNNNEDVPDHLLVEGEEKEVQEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7317 - protein, 80 aa, Nicotiana benthamiana
MTKYERARILGTRALQISMNAPVMVELEGETDLFEIAMKELREKKIPFTIRRYLPDGSYEDWGVDELIVEDTWKRQVGGA

SEQ ID NO: 7318 - protein, 143 aa, Cucurbita pepo
MADDDYNDLDMGYDDEPPEPELEEGAEEELDNNNNDDVPGEPVEAEEKEDEEPVERVRKTSKFMTKYERARILGTRALQISMNAPVMVELEGETDPLEIAMKELRERKIPFTIRRYLPDGSYEDWGVDELIVEDSWKRQVGGA

SEQ ID NO: 7319 - protein, 142 aa, Phalaenopsis aphrodite
MADDDYNDMDMGYEDEPPEPEIEEGAEVEEDNNDDVPDDVVGVENEEKDQEPVEKPRKTSKYMTKYERARILGTRALQISMNAPVMVELEGETDPLEIAMKELRQRKIPFTIRRYLPDGSYEDWGVDELIVEDSWKRQVGGD

SEQ ID NO: 7320 - protein, 145 aa, Sarracenia psittacina
MADEDYEMDGGYDDEPLEPEPELDEGVEEDVDNNNNDDVPDPLLAETEEKDDQEPRERPRKTSKYMTKYERARILGTRALQISMNAPVMVELEGETDPLEIAMKELRQRKIPFTIRRYLPDGSYEDWGVDELIVEDSWKRQVGGD

SEQ ID NO: 7321 - protein, 143 aa, Citrullus lanatus
MADDDYNDLDMGYEDEPPEPEIEEGAEEELDNNNNDDVPGEPVEAEEKEDEEPVERVRKTSKFMTKYERARILGTRALQISMNAPVMVELEGETDPLEIAMKELRERKIPFTIRRYLPDGSYEDWGVDELIVEDSWKRQVGGA

SEQ ID NO: 7322 - protein, 66 aa, Fraxinus spp
MTKYERARILGTRALQISMNAPVMVELEGETDPLEIAMKELRERKIPFTIRRYFLMEVTKTGELMN

SEQ ID NO: 7323 - protein, 141 aa, Coffea canephora
MADEDFEMDGGYEEEPLDPEPEEGAELEEENNNEEGPDPVLGENEEKQDVPVERPRKTSKYMTKYERARILGTRALQISMNAPVMVELEGETDPLEIAMKELRERKIPFTIRRYLPDGSYEDWGVNELIVEDSWKRQVGGD

SEQ ID NO: 7324 - protein, 142 aa, Lippia dulcis
MADEDYDMDGGYEDEPPEPELDEGAELEEDTAAEEIPDAEEGGGDEKQEQEAVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7325 - protein, 142 aa, Vinca minor
MADEDYDMDGGYEDEPVEPEADEGAEVEEENNNEENADPILGDAEEKQEEEPRERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7326 - protein, 142 aa, Vinca minor
MADEDYDMDGGYEDEPVEPEPDEGAEVEEENNNEEGVDTILGDTEEKQEEEPKERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7327 - protein, 142 aa, Cucumis melo
MADDDYNDLDMGYEDEPPEPEIEEGAEEELDTNNDDVPGEPVEAEEKEDEEPVERVRKTSKFMTKYERARILGTRALQISMNAPVMVELEGETDPLEIAMKELRERKIPFTIRRYLPDGSYEDWGVDELIVEDSWKRQVGGA

SEQ ID NO: 7328 - protein, 143 aa, Momordica charantia
MADDDYNDLDMGYEDEPPEPEMEEGAEEELDNNNNDDVLGEPVEAEEKEDEEPVERVRKTSKFMTKYERARILGTRALQISMNAPVMVELEGETDPLEIAMKELRERKIPFTIRRYLPDGSYEDWGVDELIVEDSWKRQVGGA

SEQ ID NO: 7329 - protein, 143 aa, Cajanus cajan
MADDDYDDMDMGYEDEPQEPEIEEGAEEELDNNKNDDATGDPLETVEKEEEQPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7330 - protein, 144 aa, Unknown
  Sequence found in Organisms: Ambrosia trifida, Parthenium argentatum
MADEEYEMDGGYDDEPMEPEADEGAEEDVDGENKDDDAPDPLLGDDEEKEEQEQGERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7331 - protein, 143 aa, Vaccinium corymbosum
MADDGDYDMDGGYEDEPIEPEPEEGAEEEADNENNDDAVDALLAEAEEKEDEPTERARKTSKYMTKYERARIFSTRALQISMNAPVMVELEGETDPLEIAMKELRERKIPFTIRRYLPDGSYEDWGVDELIVEDSWKRQVGGD

SEQ ID NO: 7332 - protein, 142 aa, Chelidonium majus
MADEDYNEMDMGYEDEPVEPEIEEGAEEEVENNNEDVADPLVDGEEKEEQEPVERARKTSKYMTKYERARILGTRALQISMNAPVMVELEGETDPLEIAMKELRERKIPFTIRRYLPDGSYEDWGVDELIVEDSWKRQVGGE

SEQ ID NO: 7333 - protein, 142 aa, Allium cepa
MADDDYNDMDMGYEDEPPEPEIEEGAEEDIDNNNEDVPEDIIGEGEEKEQEEVERARKTSKYMTKYERARILGTRALQISMNAPVMVELEGETDPLEIAMKELRERKIPFTIRRYLPDGSYEDWGVDELIVEDSWKRQVGGD

SEQ ID NO: 7334 - protein, 145 aa, Malus domestica
MADDDYNDVDMGYQDEPPEPEIEEGAEEEDVDNLNNDDDVAGDPIEAEEKEEQEGVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7335 - protein, 144 aa, Elaeis guineensis
MADDDYNDMDFGGYEDEPPEPEVEEGGEEERENNNDDVPDDVVGAEAEEKEQVSVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7336 - protein, 142 aa, Bruguiera gymnorhiza
MADDDYNDDLGYEDEPPEPEIEEGAEEEDVDNANEDIPGEPIETEDRAEQEPVERLRKTSKFMTKYERARILGTRALQISMNAPVMVELEGETDPLEIAMKELRERKIPFTIRRYLPDGSYEDWGVDELIVEDSWKRQVGGD

SEQ ID NO: 7337 - protein, 143 aa, Euphorbia peplus
MADDDYNDMDMGYEDEPPEPEIEEGADEELENNNNDDVPGDPIETEDREEQEAVERPRKTSKYMTKYERARILGTRALQISMNAPVMVELEGETDPLEIAMKELRERKIPFTIRRYLPDGSYEDWGVDELIVEDSWKRQVGGN

SEQ ID NO: 7338 - protein, 144 aa, Flaveria ramosissima
MADEEYEMDGGYDDEPMEPEAEEGAEEDVEGENKDDDAPDPLLGDDEEKEDQEQGERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7339 - protein, 144 aa, Flaveria ramosissima
MADEEYEMDGGYDDEPMEPEAEEGAEEDVEGENKDDDAPDPLLGDDEEKEEQEQGERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7340 - protein, 145 aa, Elaeis guineensis
MADDDYNDMDMGYEDEPPEPEIEEGAEKEDADNNNEEIPDTFIGTEAEEKEEQAPVERPRRTSKYMTKYERARILGTRALQISMNAPVMVELEGETDPLEIAMKELRERKIPFTIRRYLPDGSYEDWGVDELIVEDSWKRQVGGD

SEQ ID NO: 7341 - protein, 145 aa, Helianthus annuus
MADDDYEMDVGGYEDEPIEPELDEGVEEDVDGENKDEDIPDPLLGENEEKEEGEGVEKPRKTIKYMTKYERARILGTRALQISMNAPVMVELEGETDPLEIAMKELRQRKIPFTIRRYLPDGSYEDWGVDELIVEDSWKRQVGGE

SEQ ID NO: 7342 - protein, 143 aa, Citrullus lanatus
MADDDYNDLDMGYEDEPPEPEIEEGAEEELDTTNNDDVAGEPVEAEEKEDEEPVERVRKTSKFMTKYERARILGTRALQISMNAPVMVELEGETDPLEIAMKELRERKIPFTIRRYLPDGSYEDWGVDELIVEDSWKRQVGGA

SEQ ID NO: 7343 - protein, 144 aa, Actinidia deliciosa
MADEDYEMDGGYDDEPVEPEPDEGAEEEADNDNNNEDIPDPLLADTEDKNGQERGEKSRKTSKYMTKYERARILGTRALQISMNAPVMVELEGETDPLEIAMKELRQRKIPFTIRRYLPDGSYEDWGVDELIVEDSWKRQVGGD

SEQ ID NO: 7344 - protein, 144 aa, Helianthus annuus
MADEEYEMDGGYEDEPMEPEADEGAEEDVDGENKDDEAPDPLLGDDEDKEEQEQGERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7345 - protein, 144 aa, Helianthus annuus
MADEEYEMDGGYEDEPMEPEADEGAEEDVDGENKDDDAPDPLLGDDEDKEEQEQGERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7346 - protein, 136 aa, Fraxinus spp
MDGGYEDEPIEPELDEGAEVEEENNNNEDAPDAFEGEGEDKQEQEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7347 - protein, 145 aa, Lactuca sativa
MADDDYDMDAGGYDDEPAEPELDEGAEEEIDGDKVEEDVPDPLLGDNEDKEEQEAVEKPRKTIKYMTKYERARILGTRALQISMNAPVMVELEGETDPLEIAMKELRQRKIPFTIRRYLPDGSYEDWGVDELIVEDSWKRQVGGD

SEQ ID NO: 7348 - protein, 146 aa, Artemisia annua
MADDDYDMDAGGYDDEPVEPELDEGAEEDIDGDAKDEDVPDPLMGDGEDNKEEQEPVDKPRKTIKYMTKYERARILGTRALQISMNAPVMVELEGETDPLEIAMKELRQRKIPFTIRRYLPDGSYEDWGVDELIVEDSWKRQVGGE

SEQ ID NO: 7349 - protein, 143 aa, Musa acuminata
MADDDYDDVDMGYEDEPPEPEIEEGVEEDQENNNEDMPDDVVGAEGEEKEQERVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7350 - protein, 143 aa, Manihot esculenta
MADDDYNEMDMGYEDEPPEPEVEEGAEEDVDNNNNEDVQGEPIETEDKEDQEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7351 - protein, 143 aa, Cucurbita pepo
MADDDYNDVDMGYEDEPPEPEMEEGAEEELDNNNADDVPGEPVEAEDKEDEEPIERVRKTSKFMTKYERARILGTRALQISMNAPVMVELEGETDPLEIAMKELRERKIPFTIRRYLPDGSYEDWGVDELIVEDSWKRQVGGA

SEQ ID NO: 7352 - protein, 142 aa, Unknown
  Sequence found in Organisms: Euphorbia peplus, Euphorbia esula
MADDDYNDMDIGYEDEPAEPEIEEGADEEIDNNNEDVPGDPIEAEDREEQEAVERPRKTSKYMTKYERARLLGTRALQISMNAPVMVELEGETDPLEIAMKELRERKIPFTIRRYLPDGSYEDWGVDELIVEDSWKRQVGGN

SEQ ID NO: 7353 - protein, 143 aa, Populus trichocarpa
MADEDYNDVDMGYEDEPPEPEIEEGVEEDADNDNNEDDKGEPIETEDKEEQEPVERPRKTSKFMTKYERARILGTRALQISMNAPVMVELEGETDPLEIAMKELRERKIPFTIRRYLPDGSYEDWGVDELIVEDSWKRQVGGD

SEQ ID NO: 7354 - protein, 145 aa, Helianthus annuus
MADDDYEMDVGGYEDEPIEPELDEGVEEDVDGENKDEDIPDPLLGENEDKEEGEGVEKPRKTIKYMTKYERARILGTRALQISMNAPVMVELEGETDPLEIAMKELRQRKIPFTIRRYLPDGSYEDWGVDELIVEDSWKRQVGGE

SEQ ID NO: 7355 - protein, 65 aa, Sarracenia psittacina
MADEDYEMDGGYDDEPLEPEPELDEGVEEDADNNTNDDVPDPLLAENEKKMIRNQESDLGRHQSI

SEQ ID NO: 7356 - protein, 143 aa, Unknown
  Sequence found in Organisms: Prunus persica, Prunus persica
MADEDYNDMDMGYEDEPPEPEIEEGAEEDVDNINNDDLPGDAIEAEDKEEQAQVEGPRKTSKFMTKYERARILGTRALQISMNAPVMVELEGETDPLEIAMKELRERKIPFTIRRYLPDGSYEDWGVDELIVEDSWKRQVGGD

SEQ ID NO: 7357 - protein, 142 aa, Fragaria vesca
MADDDYNEMDIGYEDEPVEPEMEEGAEEEDLDNNDDMAGDAIETDDKEEQAPVERPRKTSKFMTKYERARILGTRAVQISMNAPVMVELEGETDPLEIAMKELRERKIPFTIRRYLPDGSYEDWGVDELIVEDSWKRQVGGN

SEQ ID NO: 7358 - protein, 143 aa, Amsonia hubrichtii
MADEDFEMDGGYDDEPVEPEPEEGAEVEEENNNNEDGLDPILGDTDDKQEEVPRERPRKTSKFMTKYERARILGTRALQISMNAPVMVELEGETDPLEIAMKELRERKIPFTIRRYLPDGSYEDWGVDELIVEDSWKRQVGGD

SEQ ID NO: 7359 - protein, 141 aa, Antirrhinum majus
MADEEYEMDGGYDDEPMEPELEEGVEAEEENNEEAPDLMEGEGDDKQDQEPIERPRKTSKYMTKYERARILGTRALQISMNAPVMVELEGETDPLEIAMKELRERKIPFTIRRYLPDGSYEDWGVDELIVEDSWKRQVGGQ

SEQ ID NO: 7360 - protein, 143 aa, Ipomoea nil
MADEDYEMDGGYEEEPVEPEIEEGVEPEEDNAQPEDVPDALMGDGDDKNEQDAVERPRKTSKYMTKYERARILGTRALQISMNAPVMVELEGESDPLEIAMKELRERKIPFTIRRYLPDGSYEDWGVDELIVEDSWKRQVGGA

SEQ ID NO: 7361 - protein, 145 aa, Cichorium intybus
MADDDYDMDAGGYDDEPNEPELEEGAEEEIDGDKPDEDVPDPLLGDNEDKEEQEAVEKPRKTIKYMTKYERARILGTRALQISMNAPVMVELEGETDPLEIAMKELRQRKIPFTIRRYLPDGSYEDWGVDELIVEDSWKRQVGGD

SEQ ID NO: 7362 - protein, 64 aa, Guizotia abyssinica
MADEDYEMDGGYDDEPMEPEAEEGAEEDVEGENKDDDAPDPLLGDNEGKEDQEQGERPRGGQST

SEQ ID NO: 7363 - protein, 145 aa, Ambrosia trifida
MADDDYEMDVGGYEDEPVEPELDEGAEEDVDGENKDEDIPDPLLGDNDDKEEGEGVEKPRKTIKYMTKYERARILGTRALQISMNAPVMVELEGETDPLEIAMKELRQRKIPFTIRRYLPDGSYEDWGVDELIVEDSWKRQVGGE

SEQ ID NO: 7364 - protein, 145 aa, Ambrosia trifida
MADDDYEMDVGGYEDEPIEPELDEGAEEDVDGENKDEDIPDPLLGDNDDKEEGEGVEKPRKTIKYMTKYERARILGTRALQISMNAPVMVELEGETDPLEIAMKELRQRKIPFTIRRYLPDGSYEDWGVDELIVEDSWKRQVGGE

SEQ ID NO: 7365 - protein, 142 aa, Musa acuminata
MADDDYDDVDMGYEDEPPEPEIEEGVEEDQENNEDAPDDVVGPEAEDKEQEKVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7366 - protein, 142 aa, Cucumis sativus
MADDDYNDLDMGYEDEPPEPEIEEGAEEELDTNTDDVPGEPVEAEGKEDEEPVERVRKTSKFMTKYERARILGTRALQISMNAPVMVELEGETDPLEIAMKELRERKIPFTIRRYLPDGSYEDWGVDELIVEDSWKRQVGGA

SEQ ID NO: 7367 - protein, 144 aa, Flaveria ramosissima
MADEEYEMDGGYEDEPMEPEPEEGAEEDVEGENKDDDMPDPLLADNEDNEEQEQGERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7368 - protein, 143 aa, Aristolochia fimbriata
MADDDYNDMDMGYEDEPPEPEIEEGVEEEIDNNNEDLPDTVEPESEAKENEEATQRPRKTSKYMTKYERARILGTRALQISMNAPVMVELEGETDPLEIAMKELRERKIPFTIRRYLPDGSYEDWGVDELIVEDSWKRQVGGD

SEQ ID NO: 7369 - protein, 141 aa, Eucalyptus grandis
MADDDYNEVDMGYEDEPPEPELEEGVEEDVENANHEDVPDALDGEEKEEEPVERPRKTSKFMTKYERARILGTRALQISMNAPVMVELEGETDPLEIAMKELRERKIPFTIRRYLPDGSYEDWGVDELIVEDSWKRQVGGD

SEQ ID NO: 7370 - protein, 142 aa, Vitis vinifera
MADEEYNDVDMGYEDEPPEPEIEEGAEEEAENNNNEDVPDALEEQEKEVHETVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7371 - protein, 142 aa, Quercus alba
MADEDYNDLDMGYEDEPPEPEIEEGAEEDLENNANEDAPVEIEGEEREEQEPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7372 - protein, 142 aa, Allium cepa
MADDDYNDMDMGYEDEPPEPELEDGAEEEIENNNEEVADDIIGEGEEKDQESVDRVRKTSKYMTKYERARILGTRALQISMNAPVMVELEGETDPLEIAMKELRERKIPFTIRRYLPDGSYEDWGVDELIVEDSWKRQVGGD

SEQ ID NO: 7373 - protein, 141 aa, Rosa hybrid cultivar
MADDDYNEMDIGYEDEPVEPEIEEGAEEDVDNNDDLAGDAIETDDKEEQVPVERPRKTSKFMTKYERARILGTRAVQISMNAPVMVELEGETDPLEIAMKELRERKIPFTIRRYLPDGSYEDWGVDELIVEDSWKRQVGGN

SEQ ID NO: 7374 - protein, 121 aa, Zingiber officinale
MAEDDYDDVDMGYEDEPPEPEIEEGMEEDQENNNEDVPDDVVGDAEEKQQEIVERPRKTSKFMTKYERARILGTRALQISMNAPVMVELEGETDPLEIAMKELRERKIPFTIRRYLPDGSY

SEQ ID NO: 7375 - protein, 143 aa, Gerbera hybrid cultivar
MADEDYEMDGGYDDEPMEPEPEEGAEEDVEGENNDELPDPLLADTEEKEELEQGERTRKTSKYMTKYERARILGTRALQISMNAPVMVELEGETDPLEIAMKELREKKIPFTIRRHLPDGSYEDWGVDELIVEDSWKRQVGGD

SEQ ID NO: 7376 - protein, 143 aa, Primula obconica
MADEDYEMDGGYEDEPIEPELDDGAEVEEENENDEEAPDPLLADTEDKLEQEAGEKPRKTSKYMTKYERARILGTRALQISMNAPVMVVLEGETDPLEIAMKELRERKIPFTIRRYLPDGSYEDWGVDELIVEDSWKRQVGGN

SEQ ID NO: 7377 - protein, 143 aa, Manihot esculenta
MADDDFNDMDMGYEDEPPEPEIEEGAEDDVDNNNNEDVPGEPIETEDKEEQEPVEHPRKTSKYMTKYERARILGTRALQISMNAPVMVELEGETDPLEIAMKELRQRKIPFTIRRYLPGGSYEDWGVDELIVEDSWKRQVGGD

SEQ ID NO: 7378 - protein, 142 aa, Euonymus alatus
MADDDYNDVDMGYEDEPPEPEIEEGAEEDVDNDNNDDIPGEPIETEEIEKEVGERARKTSKYMTKYERARILGTRALQISMNAPVMVELEGETDPLEIAMKELRERKIPFTIRRYLPDGSYEDWGVDELIVEDSWKRQVGGD

SEQ ID NO: 7379 - protein, 142 aa, Euonymus alatus
MADDDYNDVDMGYEDEPPEPEIEEGAEEDVDNDNNDDIPGEPIDTEEIEKEVGERARKTSKYMTKYERARILGTRALQISMNAPVMVELEGETDPLEIAMKELRERKIPFTIRRYLPDGSYEDWGVDELIVEDSWKRQVGGD

SEQ ID NO: 7380 - protein, 142 aa, Flaveria ramosissima
DEEYEMDGGYDDEPMEPEAEEGAEEDAEGENKDDDAPDPLLGDDEDKEEQEQGERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7381 - protein, 143 aa, Cajanus cajan
MADDDYDDMDMGYEDEPPEPEIEEGAEEDAENNKNDELTGEPLEAEDKEEGQPVERPRKTSKYMTKYERARILGTRALQISMNAPVMVELEGETDPLEIAMKELRERKIPFTIRRYLPDGSYEDWGVDELIVEDSWKRQVGGD

SEQ ID NO: 7382 - protein, 143 aa, Populus trichocarpa
MADDEYNDVDMGYEDEPAEPEIEEGADEDAENNNNEDDTGEPIETEDKEEQAPVERPRKTSKFMTKYERARILGTRALQISMNAPVMVELEGETDPLEIAMKELRERKIPFTIRRYLPDGSYEDWGVDELIVEDSWKRQVGGD

SEQ ID NO: 7383 - protein, 143 aa, Tripterygium wilfordii
MADDDYNDVDMGYEDEPPEPEIEEGAEEDIDNNNNDDVPGEPIETEENEDKEVGERARKTSKYMTKYERARILGTRALQISMNAPVMVELEGETDPLEIAMKELRERKIPFTIRRYLPDGSYEDWGVDELIVEDSWKRQVGGD

SEQ ID NO: 7384 - protein, 144 aa, Cirsium arvense
MADEEYEMDGAYEDEPMEPEPEEGAEEDVEGENKDDELPDPLLADNEEKEEQEQAERPRKTSKYMTKYERARILGTRALQISMNAPVMVELEGETDPLEIAMKELREKKIPFTIRRHLPDGSYEDWGVDELIVEDSWKRQVGGN

SEQ ID NO: 7385 - protein, 141 aa, Eschscholzia californica
MADEEYNDMDMGYEDEPPEPDVEEGVEEDAENNEDADAVVVEGEEKEEQEPKERPRKTSKYMTKYERARILGTRALQISMNAPVMVELEGETDPLEIAMKELRARKIPFTIRRYLPDGSYEDWGVDELIVEDSWKRQVGGD

SEQ ID NO: 7386 - protein, 143 aa, Humulus lupulus
MADDDYNEVDMGYEDEPPEPEIEEGAEDDVENANNDDLPGDAIETEEKEETEAVERPRRTSKFMTKYERARILGTRALQISMNAPVMVELEGETDPLEIAMKELRQRKIPFTIRRYLPDGSYEDWGVDELIVEDSWKRQVGGD

SEQ ID NO: 7387 - protein, 142 aa, Allium cepa
MADDDYNDMDMGYEDEPPEPEIEDGAEDDIDNNNEEVPDDIIGEGEEKDQESIERARKTTKYMTKYERARILGTRALQISMNAPVMVELEGETDPLEIAMKELRQRKIPFTIRRYLPDGSYEDWGVDELIVEDSWKRQVGGD

SEQ ID NO: 7388 - protein, 150 aa, Fagus grandifolia
MADEDYNDVDMGYEDEPPEPEMEEGAEEDLENNANEDVPLEVEGEEKEEREPAERPRKTSKYMTKYERARILGTRALQISMNAPVMVELEGETDPLEIAMKELRERKIPFTIRRYLPDGSYEDWGVDELIVEDSWKRQGGGRLICLWISH

SEQ ID NO: 7389 - protein, 145 aa, Cirsium arvense
MADDDFDMDAGGYDDEPVEPELDEGAEEDVDADNKEEDVPDPLVGDNEDKEETEAVEKPRKTIKYMTKYERARILGTRALQISMNAPVMVELEGETDPLEIAMKELRQRKIPFTIRRYLPDGSYEDWGVDELIVEDSWKRQVGGD

SEQ ID NO: 7390 - protein, 145 aa, Cynara scolymus
  misc_feature (3)..(3): Xaa can be any naturally occurring amino acid
  misc_feature (52)..(52): Xaa can be any naturally occurring amino acid
MAXDDFDMDAGGYDDEPVEPELDEGAEEDIDADNKEEDVPDPLVGDNEDKEXPEAVEKPRKTIKYMTKYERARILGTRALQISMNAPVMVELEGETDPLEIAMKELRQRKIPFTIRRYLPDGSYEDWGVDELIVEDSWKRQVGGD

SEQ ID NO: 7391 - protein, 146 aa, Cynara scolymus
MADEEYEMDGAYDDEPMEPEPEEGAEEDVEGENKEDELPDPLLADNEEKEEQEQEQAERPRKTSKYMTKYERARILGTRALQISMNAPVMVELEGETDPLEIAMKELRMKKIPFTIRRHLPDGSYEDWGVDELIVEDSWKRQVGGD

SEQ ID NO: 7392 - protein, 144 aa, Medicago truncatula
MADDDYNDLDIGYEDEPPKPGIEEGAEVDADDNDNNDEMAGEPIETEEKEQEEPTERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7393 - protein, 144 aa, Trigonella foenum-graecum
MADDDYNDLNIGYEDEPPEPEIEEGAEEDADDNDNNDEMAGEPIETEEKEQEEPTERPRKTSKYMTKYERARILGTRALQISMNAPVMVELEGETDPLEIAMKELREKKIPFTIRRYLPDGSYEDWGVDELIVEDSWKRQVGGD

SEQ ID NO: 7394 - protein, 133 aa, Persea americana
MADDEYNDPDMGYEDEPPEPEIEEGAEPEEDAENNNDEMADAFVAAEGEEKGDEQTVERPRKTSKYMTKYERARILGTRALQISMNAPVMVELEGETNPLEIAMKELRERKIPFTIRRYLPDGSYEDVGRSMS

SEQ ID NO: 7395 - protein, 143 aa, Unknown
  Sequence found in Organisms: Citrus clementina, Citrus sinensis
MADEDYNDLDMGYEDEPPEPEIEEGAEEDAENINNDDINGEPIETEEKEEQEQKEAARKTSKYMTKYERARILGTRALQISMNAPVMVELEGETDPLEIAMKELRERKIPFTIRRYLPDGSYEDWGVDELIVEDSWKRQVGGD

SEQ ID NO: 7396 - protein, 143 aa, Euonymus alatus
MADDDYNDVDIGYEEEPPEPELEEGAEEDIDNNNNDDVPGEPIETEENEDTEVGERARKTSKYMTKYERARILGTRALQISMNAPVMVELEGETDPLEIAMKELRERKIPFTIRRYLPDGSYEDWGVDELIVEDSWKRQVGGD

SEQ ID NO: 7397 - protein, 143 aa, Euonymus alatus
MADDDYNDIDIGYEEEPPEPELEEGAEEDIDNNNNDDVPGEPIETEENEDTEVGERARKTSKYMTKYERARILGTRALQISMNAPVMVELEGETDPLEIAMKELRERKIPFTIRRYLPDGSYEDWGVDELIVEDSWKRQVGGD

SEQ ID NO: 7398 - protein, 143 aa, Setaria italica
MADDDYNEMDMGYEDEPPEPEIEEGAEEELENNNEDTPDDVVGAEGEEKEQEKAKSERKTSKYMTKYERARILGTRALQISMNAPVMVELEGETDPLEIAMKELRARKIPFTIRRYLPDGSYEDWGVDELIVEDSWKRQVGGD

SEQ ID NO: 7399 - protein, 143 aa, Carpinus betulus
MADEDYNELDMGYEDEPVEPEIEEGAEEDVENNNNEDIAGDPVETEEKEEQQPVQRPRKTSKYMTKYERARILGTRALQISMNAPVMVELEGETDPLEIAMKELRERKVPFTIRRYLPDGSYEDWGVDELIVEDSWKRQVGGD

SEQ ID NO: 7400 - protein, 142 aa, Oryza sativa
MADDDYNDMDMGYEDEPPEPEIEEGAEEEPENNEDGPDEVVGAEAEDKEQEKTQRPRKTSKYMTKYERARILGTRALQISMNAPVMVELEGETDPLEIAMKELRARKIPFTIRRYLPDGSYEDWGVDELIVEDSWKRQVGGG

SEQ ID NO: 7401 - protein, 142 aa, Juglans hindsii x Juglans regia
MADEDYNDLDMGYEDEPPEPEIEEGAEEDIENTNNDDVPVEPEADEKGEEHPVERPRKTSKYMTKYERARILGTRALQISMNAPVMVELEGETDPLEIAMKELRERRIPFTIRRYLPDGSYEDWGVDELIVEDSWKRQVGGD

SEQ ID NO: 7402 - protein, 143 aa, Prunus mume
MADEDYNDMDMGYEDEPPEPEIEEGAEEDVENINSDDLPGDAIEAEDKEEQAQAEGPRKTSKFMTKYERARILGTRALQISMNAPVMVELEGETDPLEIAMKELRERKIPFTIRRYLPDGSYEDWGVDELIVEDSWKRQVGGD

SEQ ID NO: 7403 - protein, 143 aa, Acacia harpophylla
MADDDYNDMDMGYEDEPPEPEIEEGAEEDLENNNNDDLAGEQLETEDREEQEATERPRKTSKYMTKYERARILGTRALQISMNAPVMVELEGETDPLEIAMKELRERKIPFTIRRYLPDGSYEDWGVDELIVEDSWKKQVGGD

SEQ ID NO: 7404 - protein, 144 aa, Amorphophallus konjac
MADDDYDDMDMGYEDEPPEPEVEEGAEEEEAEKNNEDVPDAIVGEGADKEERPPVERPRRTTKYMTKYERARILGTRALQISMNAPVMVELEGETDPLEIAMKELRQRKIPFTIRRYLPDGSYEDWGVDELIVEDTWRRQVGGD

SEQ ID NO: 7405 - protein, 144 aa, Aquilegia formosa
MADEDYNDADMGYEDEPDVEIEEGIEEEVENNENEDIPDVPVGEAEEKEEQQSVKKDRKTSKYMTKYERARILGTRALQISMNAPVMVELEGETDPLEIAMKELRDRKIPFTIRRYLPDGSYEDWGVDELIVEDSWKRQVGGDR

SEQ ID NO: 7406 - protein, 143 aa, Castanea mollissima
MADEDYNDLDMGYEDEPPEPEIEEGAEEDPENNANEDVPGDLVEGEDKEEPEPVERPRKTSKYMTKYERARILGTRALQISMNAPVMVELEGETDPLEIAMKELRQRKVPFTIRRYLPDGSYEDWGVDELIVEDSWKRQVGGD

SEQ ID NO: 7407 - protein, 141 aa, Eschscholzia californica
MADEEYNDMDMGYEDEPPEPDVEEGVEEDAENNEDADAVVVEGEEKEEREPKERPRKTSKYMTKYERARILGTRALQISMNAPVMVELEGETDPLEIAMKELRARKIPFTIRRYLPDGSYEDWGVDELIVEDSWKRQVGGD

SEQ ID NO: 7408 - protein, 142 aa, Tropaeolum majus
MADEDYNDDMGYEDEPAEPELEEGIEEDADNKDNDDDMGEPLETEGKGDQEPGERPRKTSKFMTKYERARILGTRALQISMNAPVMVELEGETDPLEIAMKELRERKIPFTIRRYLPDGSYEDWGVDELIVEDSWKRQVGGD

SEQ ID NO: 7409 - protein, 143 aa, Quercus alba
MADEDYNDLDMGYEDEPPEPEIEEGAEEDLENNANEDVPGDLVEGEDKEEPEPVERPRKTSKYMTKYERARILGTRALQISMNAPVMVELEGETDPLEIAMKELRQRKVPFTIRRYLPDGSYEDWGVDELIVEDSWKRQVGGD

SEQ ID NO: 7410 - protein, 177 aa, Solanum phureja
MELNANVSTKRTINPRKTDIGGKPFILIICGSLVYYHCAYRNSSLVSLISDVFIVLLCSLAILGLLFRQMNISVPVDPLEWQISQDAANMFFACLANTIGAAESVLRVAATGHDKRLFLKVVAALYVLSSLGRIASGVTIAYAGLCFLCLYMLAENLQLISSRYPRRRDGTNTVQDD

SEQ ID NO: 7411 - protein, 177 aa, Solanum tuberosum
MELNANVSTKRTINPMKTDIEGKPFILIICGSLVYYHCAYRNSSLVSLISDVFIVLLCSLAILGLLFRQMNISVPVDPLEWQISQDAANMFFACLANTIGAAESVLRVAATGHDKRLFLKVVAALYVLSSLGRIASGVTIAYAGLCFLCLYMLAENLQLISSRYPRRRDGMNTVQDD

SEQ ID NO: 7412 - protein, 175 aa, Solanum melongena
MDTNESAARTINPRKADIGGKPFILIICGSLVYYHCAYRNSSLVSLISDVFIVLLCSLAILGLLFRQMNISVPVDPLEWQISQDAANSFFACLANTISAAESVLRVAATGHDKRLFFKVVAALYVLSSLGRIASGVTIAYAGLCFFCLYMLAENLQLISSRYPCRKDCTNTIQDD

SEQ ID NO: 7413 - protein, 177 aa, Nicotiana benthamiana
MELNVNETTARTINPRKADVGGKPFILIICGSLVYYHCAYRNSSLVSLVSDVFIVLLCSLAILGLLFRQMNISVPVDPLEWQISQDAANSVFACLANTIGAAESVLRVAATGHDKRLFFKVVATLYVLSALGRVASGVTIAYAGLCFLCLYMLAENLQLISSRNPRLRDCTNTVQDD

SEQ ID NO: 7414 - protein, 177 aa, Nicotiana benthamiana
MELNVNETTARTINPRKADVGGKPFILIICGSLVYYHCAYRNSSLVSLVSDVFIVLLCSLAILGLLFRQMNISVPVDPLEWQISQDAANSVFAGLANTIGAAESVLRVAATGHDKRLFFKVVVTLYVLSALGRIASGVTIAYAGLCFLCLYMLAENLQLISSRNPRRRDCTNTVEDD

SEQ ID NO: 7415 - protein, 108 aa, Capsicum annuum
MNISVPVDPLEWQISQDAANRFFACLANTIGAAESVLRVAATGHDKRLFFKVVVALYVLSALGRIASGVTIAYAGLCFLCLYMLSENLQLISSRYTMRRGCTNTVQDD

SEQ ID NO: 7416 - protein, 215 aa, Solanum tuberosum
MLGKSFATPLLTFNSASCFSSPGCDSVSTTANTLVGYVNCSSSITFNVTRGSWTSNYPSKKWTLHSTVTDNIVLTEEEKKTWNDSRQALSALKFSPDEEDKILGKAFGHIHSPYWYEERKKEVPRLEVVNEILDYLRSLSLTDDDLTKLVKKFPEVLGCSLEDEMKTNVEILEKQWGIEGKTLRNLLLRNPKVLGYNVDCKGDCVAKCTRCWARF

SEQ ID NO: 7417 - protein, 215 aa, Solanum phureja
MLGKSFATPLLTFNSASCFSSPGCDSVSTTAYTLVGYVNCSSSITFNVTRGSWTSNYPSKKWTLHSTVTDNIVLTEEEKKTWNDSRQALSALKFSPDEEDKILGKAFGHIHSPYWYEERKKEVPRLEVVNEILDYLRSLSLTDDDLTKLVKKFPEVLGCSLEDEMKTNVEILAKQWGIEGKTLRNLLLRNPKVLGYNVDCKGDCVAKCTRCWARF

SEQ ID NO: 7418 - protein, 214 aa, Capsicum annuum
MLGKSFATPLLTFNPASCCSPGCDSSSTTASSLIGYINCSNNITSNVTMGSWKSNYPSRKWTLHSTATDNIALTEEEKKTWNDSRQTLSALKFSPEEEDKILGKAFGHIHSPYWYEERKKEVPRLEVVNEILDYLRSLNLTDDDLIKLLKKFPEVLGCSLEDEMKNNVEILAKQWGIEGKTLRNLLLRNPKVLGYNVDCKGDCVAKCTRCWARF

SEQ ID NO: 7419 - protein, 216 aa, Nicotiana benthamiana
MLGKSFASPLLTFNPASCFSSPGCDSGSTAANNLAWWYVNCSNNFTSNVTKGSWTSDNLPKKWKLHSTATDNIELTEEEKKTWNDSREALSAFKFSPEEEDKILGKAFGQIHSPYWYEERKKEVPRLEVVNEILDYLRSLSLTDDDLTKLLKKFPEVLGCSLEDEMKNNVEILAKQWGIEGKTLTKVLLRNPKVLGYNVDCKGDCVAKCTRCWARF

SEQ ID NO: 7420 - protein, 103 aa, Nicotiana tabacum
  misc_feature (9)..(9): Xaa can be any naturally occurring amino acid
MLGKSFASXLLTFNSVSCFSSPGCDSGSIAANNLVGWYVNCSNNFTSNVTKGSWTSDNLPKKWKLHSTATDNIELTEEEKKHGMIAEKLCLHSNLALRRKTKS

SEQ ID NO: 7421 - protein, 200 aa, Solanum tuberosum
MASLLNPPLILPQNKLNPGGVLAASTSGIPSKKFQPSSTRWSHRRCLLMRTKTSVERDMLANDSVGTDAVDDKDFGVVCMHHVGILCENLERSLDFYQNILGLEINEARPHEKLPYRGAWLWVGSEMIHLMELPNPDPFTGRPEHGGRDRHTCIAIRDVSKLKAILDKACIPYTLSRSGRPAIFTRDPDTNALEFTQVDA

SEQ ID NO: 7422 - protein, 200 aa, Solanum phureja
MASLLNPPLTLPQNKLNPGGLFAASTSGIPSKKFQPSSTRSSHRRCLLIRAKTSVETDMLANDSVGTDAVDDKDFGVVCMHHVGILCENLERSLDFYQNILGLEINEARPHEKLPYRGAWLWVGSEMIHLMELPNPDPFTGRPEHGGRDRHTCIAIRDVSKLKAILDKAGIPYTLSRSGRPAIFTRDPDTNALEFTQVDA

SEQ ID NO: 7423 - protein, 197 aa, Solanum melongena
MASLLNPHLTLPQNKLNPGGGLAVFTSGIPNKNFQRSQWSHRHCLLIRAKTAETDMLAKDSVGTNAVDDKDFGVVSMHHVGILCENLERSLDFYQNILGLEINEARPHDKLPYRGAWLWVGSEMIHLMELPNPDPKTGRPEHGGRDRHTCIAIRDVSKLKAILDKAGIPYTLSRSGRPAIFTRDPDTNALEFTQVDA

SEQ ID NO: 7424 - protein, 200 aa, Capsicum annuum
MASLINPPLTLPQNKLNPGGVLAVSTSGITNKIFQPSSTRWNHRRCLLMRAKTSVEMDMLAKESVGTNAVDNKDFGVVSMHHVGVLCENLERSLDFYQNILGLKINEARPHDKLPYRGAWLWVGTEMIHLMELPNPDPLTGRPEHGGRDRHTCIAIRDVSKLKAVLDKAGIPYSLSHSGRPAIFTRDPDANALEFTQVDA

SEQ ID NO: 7425 - protein, 201 aa, Nicotiana tabacum
MASLLNPPLTLPQNKLNPGGVLSVATSTIPCKKFQPFLTRQRSHRHCLLMRAKASVETDMLAKDSVGANAVDDKDFGVVSMHHVGILCENLERSLDFYQNILGLEINEARPHDKLPYRGAWLWVGSEMIHLMELPNPDPLTGRPEHGGRDRHTCIAIRDVSKLKVILDEAGIPYTLSRSGRPAIFTRDPDANALEFTQVDA

SEQ ID NO: 7426 - protein, 201 aa, Nicotiana benthamiana
MASLLNPPLTLPQNKLNPGGVLSVATSTIPCKKIQPFLTRQRSHRHCLLMRAKASVETDMLAKDSVGADAVDDKDFGVVSMHHVGILCENLERSLDFYQNILGLEINEARPHDKLPYRGAWLWVGSEMIHLMELPNPDPLTGRPEHGGRDRHTCIAIRDVSKLKVILDEAGIPYTLSRSGRPDIFTRDPDANALEFTQVDA

SEQ ID NO: 7427 - protein, 201 aa, Nicotiana benthamiana
MASLLNPPLTLPQNKLNPGGVLSVAISTIPCKKFQPFLTRQRSPRLCLLMRAKASVETDMLAKDSVGADAVDDNDFGVVSMHHVGILCENLERSLDFYQNILGLEINEARPHEKLPYRGAWLWVGSEMIHLMELPNPDPLTGRPEHGGRDRHTCIAIRDVSKLKVILDEAGIPYTLSRSGRPAIFTRDPDANALEFTQVDA

SEQ ID NO: 7428 - protein, 83 aa, Solanum tuberosum
MASGWGITGNKGRCYDFWMDFSECMSRCREPKDCVLLREDYFECLHHSKEYQRRNRIYKEEQRQLRAASQKKKEGVDGGGGHH

SEQ ID NO: 7429 - protein, 85 aa, Solanum phureja
MASGWGITGNKGRCYDFWMDFSECMSRCREPKDCVLLREDYFECLHHSKEYQRRNRIYKEEQRQLRAASQKKKEGVDGGGGGGHH

SEQ ID NO: 7430 - protein, 83 aa, Solanum melongena
MASGWGITGNKGRCYDFWMDFSECMSRCREPKDCTLLREDYFECLHHSKEYQRRNRIYKEEQRQLRAASQKKKEGEDGGGGHH

SEQ ID NO: 7431 - protein, 83 aa, Nicotiana tabacum
MASGWGITGNKGRCYDFWMDFSECMSRCREPKDCSLLREDYFECLHHSKEYQRRNRIYKEEQRQLRAASQKKKEGGDGGGGHH

SEQ ID NO: 7432 - protein, 83 aa, Nicotiana benthamiana
MASGWGITGNKGRCYDFWMDFSECMSRCREPKDCSLLREDYFECLHHSKEYQRRNRIYKEEQRQLRAASQKKKEGGDGGGGHN

SEQ ID NO: 7433 - protein, 85 aa, Capsicum annuum
MASGWGITGNKGRCYDFWMDFSECMSKCREPKDCSLLREDYFECLHHSKEYQRRNRIYKEEQRQLRAAAQKKKEGGDVGGGGGHH

SEQ ID NO: 7434 - protein, 82 aa, Petunia hybrida
MASGWGITGNKGRCYDFWMDFSECMSRCREPKDCSLLREDYFECLHHSKEYQRRNRIYKEEQRQLRAASQKNKDDGGGGGHH

SEQ ID NO: 7435 - protein, 82 aa, Coffea canephora
MASGWGITGNKGRCYDFWMDFSECMSRCREPKDCALLREDYFECLHHSKEFQRRNRIYKEEQRQLRAATQKGEDGGHGGSHH

SEQ ID NO: 7436 - protein, 81 aa, Olea europaea
MASGWGITGNKGRCYDFWMDFSECMSRCREPKDCALLREDYFECLHHSKEFQRRNRIYKEEQRQLRAAAQKAKGGGDDGHH

SEQ ID NO: 7437 - protein, 84 aa, Ipomoea batatas
MASGWGITGNKGRCYDFWMDFSECMSRCREPKDCALLREDYLECLHHSKEYQRRNRIYKEEQRQLRAATHKEKEGGHGDGGTHH

SEQ ID NO: 7438 - protein, 81 aa, Unknown
  Sequence found in Organisms: Fraxinus spp, Olea europaea
MASGWGITGNKGRCYDFWMDFSECMSRCREPKDCALLREDYFECLHHSKEFQRRNRVYKEEQRQLRAAAQKVKGGGDDGHH

SEQ ID NO: 7439 - protein, 84 aa, Ipomoea nil
MASGWGITGNKGRCYDFWMDFSECMSRCREPKDCSLLREDYLECLHHSKEYQRRNRIYKEEQRQLRAAVHNEKEGGHGDGGTHH

SEQ ID NO: 7440 - protein, 85 aa, Lactuca sativa
MASGWGITGNKGRCYDFWMDFSECMSRCREPKDCSLLREDYLECLHHSKEFQRRNRIYKEEQRQIRAAAQKAKGGVGDGDGVPHH

SEQ ID NO: 7441 - protein, 83 aa, Amsonia hubrichtii
MASGWGINGNKGRCYDFWIDFSECMSRCREPKDCSLLREDYLECLHHSKEYQRRNRIYKEEQRQLRAAAQKANEGGHGGGSHH

SEQ ID NO: 7442 - protein, 83 aa, Catharanthus roseus
MASGWGITGNKGRCYDFWIDFSECMSRCREPKDCSLLREDYLECLHHSKEYQRRNRIYKEEQRQLRAAAQKANEGGHDGGSHH

SEQ ID NO: 7443 - protein, 83 aa, Unknown
  Sequence found in Organisms: Centaurea maculosa, Cirsium arvense, Helianthus annuus
MASGWGITGNKGRCYDFWMDFSECMSRCREPKDCSLLREDYLECLHHSKEFQRRNRIYKEEQRQIRAAAQKAKGGDGDGVPHH

SEQ ID NO: 7444 - protein, 451 aa, Centaurea maculosa
MLGMFQNEWDALVLSAFASEQQLHTTRQELSHCLYQHDSACRVIARLKKELDEARTMLANLERQAPMPASTAMPANASAAINGKRAAEGDELGPDGKKIRPGISASIIAELTDCNAALSQQRKKRQIPSSLAPLDAVERYTQLNSYPLHKTNKAGILSIDIHHSKGIIATGGVDTNAVVFNQTSGEILSTLSGHSKKVTSVKFVADGELVVTGSADKTVRVWQGSEDGNYDCRHVLKDHAAEVQAVTVHATNGYFVTASLDNTWCFYELSSGLCLAQVADSSESDGYTSAAFHPDGLILGTGTTGSLVKIWDVKSQANVARFDGHVGAVTAISFSENGYFLATAAQDGVKLWDLRKLRNFRSFTPYDENTPTQSVEFDHSGSYLALGGSDIRVYQVANVKSEWNCIKTFPDLSGTGKINSVKFGRDAKYIAVGSMDRNLRLFGLPEETTES

SEQ ID NO: 7445 - protein, 378 aa, Cirsium arvense
SSPPLNLPTSYPSSTVNHHTSAVAAVSGHTKRRLSLTRTLVAKASENDDETPSSFNPFGFVTDNPSSRSAIQLPEAPAEDGNVGQMLYRIEDKGREYGSYIKSGGFRWFVRETGSSDARLGPRGTVVFLHGAPTQSYSYRVVMSQLADSGFHCFAPDWIGFGFSDKPQPGYGYDYTEKEYHEQLDKLLDKLEIKSPFSLVVQGFLVGSYGLTWALKNPSRISKLVIMNTPLTTSSPIPGLFQQLRIPLLGEFTCQNAIMAERFIEAGSAYVLKVEKADVYRLPYLRSSGPGFALLEAAKRINFRATAGQIADGFKPERWDKPILVAWGMSDKYLPQSIAEEFQKGNPSAVTLKLIEGAGHMPQEDWPEKVIDALRYFL

SEQ ID NO: 7446 - protein, 83 aa, Carthamus tinctorius
  misc_feature (72)..(72): Xaa can be any naturally occurring amino acid
MASGWGITGNKGRCYDFWMDFSECMSRCREPKDCSLLREDYLECLHHSKEFQRRNRIYKEEQRQIRAAAQKXKGGDGDGVPHH

SEQ ID NO: 7447 - protein, 83 aa, Tabernaemontana elegans
MASGWGITGNKGRCYDFWIDFSECMSRCREPKDCSLLREDYLECLHHSKEYQRRNRIYKEEQRQLRAAARKADEGEHGGGSHH

SEQ ID NO: 7448 - protein, 85 aa, Helianthus annuus
MASGWGITGNKGRCYDFWMDFSECMSRCREPKDCSLLREDYLECLHHSKEFQRRNRIYKEEQRQIRAAAQKAKGGDGDGDGVPHH

SEQ ID NO: 7449 - protein, 85 aa, Taraxacum officinale
MASGWGITGNKGRCYDFWMDFSECMSRCREPKDCSLLREDYLECLHHSKEFQRRNRIYKEEQRQIRAAAQKAKSGGGDGDGVPHH

SEQ ID NO: 7450 - protein, 64 aa, Artemisia annua
MASGWGITGNKGRCYDFWMDFSECMSRCREPKDCGLLREDYLECLHHSKSFNDVTGYTKRSNAR

SEQ ID NO: 7451 - protein, 105 aa, Fraxinus spp
MASGWGITGNKGRCYDFWMDFSECMSRCREPKDCALLREDYFECLHHSKEFQRRNRVYKEEQRQLRAAAQKVKGVEMMAITDNHYCLFFNQLKNGRKVSVVSRTC

SEQ ID NO: 7452 - protein, 65 aa, Ipomoea batatas
MDFSECMSGCREPKDCALLREDYLECLHHSKEYQRRNRIYKEEQRQLRAAVQKDKAGENGGGTHH

SEQ ID NO: 7453 - protein, 83 aa, Arabidopsis lyrata
MASGWGITGNKGRCYDFWMDFSECMSHCREPKDCTLLREDYLECLHHSKEFQRRNRIYKEEQRKLRAASRKGEEGVDGTHTHH

SEQ ID NO: 7454 - protein, 84 aa, Aristolochia fimbriata
MASGWGITGNKGRCYDFWTDFSECMSRCREPKDCALLREDYLECLHHAKEFQRRNRIYKEEQRQIRAAERKAKEEVESGGGGHH

SEQ ID NO: 7455 - protein, 83 aa, Flaveria ramosissima
MASGWGITGNKGRCYDFWMDFSECMSRCREPKDCSLLREDYLECLYHSKEFQRRNRIYKEEQRQIRAAAQKAKGGDGDGVPHH

SEQ ID NO: 7456 - protein, 83 aa, Guizotia abyssinica
MASGWGITGNKGRCYDFWMDFSECMSRCREPKDCFLLREDYLECLHHSKEFQRRNRIYKEEQRQIRTAAQKAKGGDGDGVPHH

SEQ ID NO: 7457 - protein, 81 aa, Lippia dulcis
MASGWGITGNKGRCYDFWMDFSDCMSRCREPKDCTLLREDYFECLHHSKEFQRRNRIYKEEQRQLRASTEKAKGGGESGHH

SEQ ID NO: 7458 - protein, 84 aa, Lippia dulcis
MASGWGITGNKGRCYDFWVDFSECMSTCREPKDCGLLREDYFECLHHSKEFQRRNRVYKEEQRQLRAAADKAKGGGGGGDGGHH

SEQ ID NO: 7459 - protein, 85 aa, Platanus occidentalis
MASGWGITGNKGRCYDFWIDFSECMSRCREPKDCGLLREDYLECLHHSKEYQRRNRIYKEEQRQLRAAARKAKDGGADGGENNHL

SEQ ID NO: 7460 - protein, 85 aa, Platanus occidentalis
MASGWGITGNKGRCYDFWIDFSECMSRCREPKDCALLREDYLECLHHSKEYQRRNRIYKEEQRQIRAAAQKAKEGGGDGGENNHM

SEQ ID NO: 7461 - protein, 86 aa, Brassica oleracea
MASGWGITGNKGRCYDFWMDFSECMSHCREPKDCSLLREDYLECLHHSKEFQRRNRIYKEEQRKLRAASRKGQDTGGDATTNTSNH

SEQ ID NO: 7462 - protein, 268 aa, Theobroma cacao
MSSRSSRTLYVGNLPGDVREREVEDLFYKYGPIAHIDLKIPPRPPGYAFVEFEEARDAEDAIRGRDGYDFGGHRLRVELAHGGRGRSSVDRHSSFSGGRGRGPSRRSEYRVLVTGLPSSASWQDLKDHMRRAGDVCFSQVFRDGSGTTGIVDYTNYDDMKYAIKKLDDSEFRNAFSRAYVRVREYDSKRDSSRSPSRGRSLSRSRSRSRSRSRSRSRSRSRGRSYSRSKSHSKSPRAKPSRKSPAKSRSRSASRSRSASRTRSLSRYG

SEQ ID NO: 7463 - protein, 83 aa, Ambrosia trifida
MASGWGITGNKGRCYDFWMDFSECMSRCREPKDCSLLREDYLECLHHSKEFQRRNRIYKEEQRQIRAAAQKAKGGDTDGVPKH

SEQ ID NO: 7464 - protein, 83 aa, Brassica juncea
MASGWGITGNKGRCYDFWMDFSECMSHCREPKDCSLLREDYLECLHHSKEFQRRNRIYKEEQRKLRAASRKDEQGVDGTHTHH

SEQ ID NO: 7465 - protein, 83 aa, Vaccinium corymbosum
MASGWGITGNKGRCYDFWMDFSECMSRCREPKDCSLLREDYLECLHHSKEFQRRNRIYKEEQRQLRAAARKGKEGGDAAVHSH

SEQ ID NO: 7466 - protein, 83 aa, Flaveria ramosissima
MASGWGITGNKGRCYDFWMDFSECMSRCKEPKDCSLLREDYLECLHHSKEFQRRNRIYKEEQRQIRAAAQNAKGGDGDGVPHH

SEQ ID NO: 7467 - protein, 81 aa, Mimulus guttatus
MASGWGITGNKGRCYDFWMDFSECMSRCREPKDCTLLREDYFECLNHSKEFQRRNRVYKEEQRQLRAAAEKAKGGGVDVHH

SEQ ID NO: 7468 - protein, 82 aa, Glycine max
MASGWGITGNKGRCYDFWMDFSECMSRCREPKDCALLREDYLECLHHSKEFQRRNRIYKEEQRKLRAASRKGQEDGVNEHHH

SEQ ID NO: 7469 - protein, 83 aa, Eutrema halophilum
MASGWGITGNKGRCYDFWMDFSECMSHCREPKDCSLLREDYLECLHHSKEFQRRNRIYKEEQRKLRAASKKGEEGGDGTHTHH

SEQ ID NO: 7470 - protein, 83 aa, Eutrema parvulum
MASGWGITGNKGRCYDFWMDFSECMSHCREPKDCSLLREDYLECLHHSKEFQRRNRIYKEEQRKLRAASRKGEEGGDGTHTHH

SEQ ID NO: 7471 - protein, 84 aa, Fagus grandifolia
MASGWGITGNKGRCYDFWIDFSECMSRCREPKDCTLLREDYLECLHHSKEFQRRNRIYKEEQRKLRAAARKAKEGDVGVDNHHH

SEQ ID NO: 7472 - protein, 84 aa, Cicer arietinum
MASGWGISGNKGRCYDFWVDFSECMSTCREPKDCVLLREDYFECLHHSKEFRRRNRIYKEEQRQLRAASKKGNSEGDGVVSEHH

SEQ ID NO: 7473 - protein, 83 aa, Eucalyptus grandis
MASGWGITGNKGRCYDFWVDFSECMSRCREPKDCALLREDYLECLHHSKEFQRRNRIYKEEQRKLRAATQKTEGGDKPHGHHA

SEQ ID NO: 7474 - protein, 83 aa, Camellia sinensis
MASGWGITGNKGRCYDFWMDFSECMSRCREPKDCAFLREDYLECLHHSKEFQRRNRVYKEEQRQLRAAARKGKEGGDIAGHHH

SEQ ID NO: 7475 - protein, 299 aa, Ricinus communis
MSSRASRTLYVGNLPGDIREREVEDLFYKYGPIAHIDLKIPPRPPGYAFVEFEEARDAEDAIRGRDGYDFDGHQLRVELAHGGRGHSSSDRHSSHSGGGRGRGVSRRSEYRVLVTGLPSSASWQDLKDHMRRAGDVCFSQVFRDGSGTTGIVDYTNYEDMKHAIKKLDDSEFRNAFSRAYVRVKEYDSKRDSSRSPSRGRSHSRGRSRSRGRSSSRSRSQSKSPKTKSTRRSPARSRSRSASRSGSKPRSLSSELGIGLGSWWDLVQFLHLFWLWRYAVFQMGSFGNLHGMPCLMYLVL

SEQ ID NO: 7476 - protein, 80 aa, Antirrhinum majus
  misc_feature (10)..(10): Xaa can be any naturally occurring amino acid
ASGWGITGNXGRCYDFWMDFSECMSRCREPKDCSLLREDYFECLHHSKEFQRRNRVYKEEQRQLRAAVEKTKGGADDGHH

SEQ ID NO: 7477 - protein, 83 aa, Unknown
  Sequence found in Organisms: Arabidopsis thaliana, Arabidopsis lyrata
MASGWGITGNKGRCYDFWMDFSECMSHCREPKDCTLLREDYLECLHHSKEFQRRNRIYKEEQRKLRAASRKGEETGDGTHTHH

SEQ ID NO: 7478 - protein, 83 aa, Arabidopsis thaliana
MASGWGITGNKGRCYDFWMDFSECMSHCREPKDCTLLREDYLECLHHSKEFQRRNRIYKEEQRKLRAASRKGEEAGDGTHNHH

SEQ ID NO: 7479 - protein, 83 aa, Brassica oleracea
MASGWGITGNKGRCYDFWMDFSECMSHCREPKDCSLLREDYLECLHHSKEFQRRNRIYKEEQRKLRAASRKGEQVVDGTHTHH

SEQ ID NO: 7480 - protein, 84 aa, Castanea mollissima
MASGWGISMNKGRCYDFWIDFSECMSRCREPKDCTLLREDYFECLHHSKEFRRRNRIYKEEQRQLRAASRKGKDGEEGGDKHHH

SEQ ID NO: 7481 - protein, 84 aa, Carpinus betulus
MASGWGITGNKGRCYDFWVDFSECMSRCREPKDCTLLREDYLECLHHSKEFQRRNRIYKEEQRKLRAAARKGKEGGEGIDTHHH

SEQ ID NO: 7482 - protein, 81 aa, Orobanche aegyptiaca
MASGWGITGNKGRCYDFWTDFSECMSRCREPKDCGLLREDYFECLNHSKEFQRRNRVYKEEQRQLRAAKEKAKGGGHDVHH

SEQ ID NO: 7483 - protein, 81 aa, Salvia sclarea
MASGWGITGNKGRCYDFWVDFSECMSTCREPKDCGLLREDYFECLHHSKEFQRRNRVYKEEQRQLRAAADKASGGGDKGHH

SEQ ID NO: 7484 - protein, 81 aa, Sesamum indicum
MASGWGITGNKGRCYDFWMDFSDCMSRCREPKDCALLREDYLECLHHSKEFQRRNRVYKEEQRQLRAASEKGKGGIDDVHH

SEQ ID NO: 7485 - protein, 83 aa, Eutrema halophilum
MASGWGITGNKGRCYDFWMDFSECMSHCREPKDCSLLREDYLECLHHSKEFQRRNRIYKEEQRKLRAASRKGEETGDGTHTHH

SEQ ID NO: 7486 - protein, 83 aa, Panax ginseng
MASGWGITGNKGRCYDFWMDFSECMSRCREPKDCGLLREDYLECLHHSKEFQRRNRVYKEEQRQLRAAAQKAKGGGGDKAQNH

SEQ ID NO: 7487 - protein, 82 aa, Populus trichocarpa
MASGWGITGNKGRCYDFWMDFSECMSQCREPKDCAFLREDYLECLHHSKEFQRRNRIYKEEQRKLRAASQKADGGDGKDNHH

SEQ ID NO: 7488 - protein, 84 aa, Ricinus communis
MASGWGITGNKGRCYDFWVDFSECMSRCREPKDCGLLREDYLECLHHSKEFQRRNRIYKEEQRKLRAAKQNSKEGGDSTDKHHA

SEQ ID NO: 7489 - protein, 85 aa, Elaeis guineensis
MASGWGITGNKGRCYDFWMDFSECMSHCREPKDCSLLREDYLECLHHSKEFQRRNRIYKEEQRQIRAAARKAKGEAEEGGANTHH

SEQ ID NO: 7490 - protein, 83 aa, Sarracenia psittacina
MASGWGITGNKGRCYDFWMDFSECMSRCREPKDCALLREDYLECLHHSKEFQRRNRIYKEQQRQLRAAARNAKEGGDVAEHHH

SEQ ID NO: 7491 - protein, 82 aa, Phaseolus vulgaris
MASGWGITGNKGRCYDFWMDFSECMSRCREPKDCALLREDYLECLHHSKEFQRRNRIYKEEQRQIRVAARKGKDEGVGNDHH

SEQ ID NO: 7492 - protein, 84 aa, Aquilegia formosa
MASGWGITGNKGRCYDFWIDFSDCMSRCREPKDCVLLREDYLECLHHAKEYQRRNRIYKEEQRQIRAAARKAKEGDSGVETKVH

SEQ ID NO: 7493 - protein, 83 aa, Arabidopsis lyrata
MASGWGITGNKGRCYDFWMDFSECMSHCREPKDCTLLREDYLECLHHSKEFQRRNRIYKEEQRKLRAASRKGEETGDGTHTQH

SEQ ID NO: 7494 - protein, 83 aa, Unknown
  Sequence found in Organisms: Brassica rapa, Eutrema parvulum
MASGWGITGNKGRCYDFWMDFSECMSHCREPKDCSLLREDYLECLHHSKEFQRRNRIYKEEQRKLRAASRKGEETGDATHTHH

SEQ ID NO: 7495 - protein, 83 aa, Cleome gynandra
MASGWGITGNKGRCYDFWIDFSECMSNCRQPKDCVLLREDYLECLHHSKEFQRRNRIYKEEQRKLRAASRKGEESGDGTHDHH

SEQ ID NO: 7496 - protein, 83 aa, Cleome spinosa
MASGWGITGNKGRCYDFWVDFSECMSTCRQPKDCALLREDYLECLHHSKEFQRRNRIYKEEQRKLRAASRKGEEGGDGTNAHH

SEQ ID NO: 7497 - protein, 82 aa, Vigna unguiculata
MASGWGITGNKGRCYDFWMDFSECMSRCREPKDCGLLREDYLECLHHSKEFQRRNRIYKEEQRKIRAAAKKDKDDGVAKEHH

SEQ ID NO: 7498 - protein, 84 aa, Epimedium sagittatum
MASGWGITGDKGRCYDFWVDFSECMSRCREPKDCVLLREDYLECLHHSKEFQRRNRVYKEEQRQIRAAARKAKEGDTGGQSVPH

SEQ ID NO: 7499 - protein, 83 aa, Euonymus alatus
MASGWGISGNKGRCYDFWIDFSECMSRCREPKDCFLLREDYLECLHHSKEFQRRNRIYKEEQRKVRAAARKGKEGGDGIDKHH

SEQ ID NO: 7500 - protein, 80 aa, Flaveria ramosissima
GWGITGNKGRCYDFWMDFSECMSRCREPKDCSLLREDYLECLHHSKEFQRRNRIYKEEQRQIRAAAQKAKGGGGDGVPHH

SEQ ID NO: 7501 - protein, 82 aa, Glycyrrhiza uralensis
MASGWGITGNKGRCYDFWMDFSECMSRCREPKDCSLLREDYLECLHHSKEFQRRNRVYKEEQRKLRAAARKGQEDGVVNEHH

SEQ ID NO: 7502 - protein, 82 aa, Medicago truncatula
MASGWGITGNKGRCYDFWIDFSECMSTCREPKDCVLLREDYFECLHHSKEFQRRNRIYKEEQRKLRAAARKGQDDGKVAEHH

SEQ ID NO: 7503 - protein, 81 aa, Mimulus guttatus
MASGWGITGNKGRCYDFWMDFSECMSQCRQPKDCGLLREDYFECLNHSKEFQRRNRVYKEEQRQLRAAAEKAKGGGVDVHH

SEQ ID NO: 7504 - protein, 84 aa, Quercus alba
MASGWGISMNKGRCYDFWIDFSECMSRCREPKDCTLLREDYFECLHHSKEFRRRNRIYKEEQRQLRAASRKGKDGEEGVDKHHH

SEQ ID NO: 7505 - protein, 83 aa, Primula obconica
MASGWGITGNKGRCYDFWMDFSECMSLCREPKDCSLLREDYLECLHHSKEFQRRNRIYKEEQRQLRAAARKKEGGNVESHDQH

SEQ ID NO: 7506 - protein, 83 aa, Raphanus sativus
MASGWGITGNKGRCYDFWMDFSECMSHCREPKDCSLLREDYLECLHHSKEFQRRNRIYKEEQRKLRAASRKGEETGDASHTHH

SEQ ID NO: 7507 - protein, 82 aa, Glycine max
MASGWGITGNKGRCYDFWMDFSECMSRCREPKDCAFLREDYLECLHHSKEFQRRNRIYKEEQRKLRAATRKGQEDGVNEHHH

SEQ ID NO: 7508 - protein, 81 aa, Triphysaria pusilla
MASGWGITGNKGRCYDFWMDFSECMSRCREPKDCTLHREDYFECLHHSKEFGRRNRVYKEEQRQLRAAAENAKGRGDDGHH

SEQ ID NO: 7509 - protein, 81 aa, Triphysaria pusilla
MASGWGITGNKGRCYDFWMEFSECMSRCREPKDCTLHREDYFECLHHSKEFGRRNRVYKEEQRQLRAAAEKAKGGGDNPHH

SEQ ID NO: 7510 - protein, 83 aa, Humulus lupulus
MASGWGITGNKGRCYDFWVDFSECMSRCREPKDCTLLREDYLECLHHSKEFQRRNRIYKEEQRKIRAAARKKKEGENVDHHHA

SEQ ID NO: 7511 - protein, 82 aa, Utricularia gibba
MASGWGITGNKGRCHDFWMDFSECMSRCREPKDCTLLREDYFECLHHSKEFQRRNRVYKEEQRQLREAAEKAKGGGGDSHKH

SEQ ID NO: 7512 - protein, 85 aa, Amorphophallus konjac
MASGWGITGNKGRCYDLWNDFSECMSQCREPKDCALLREDYLECLHHAKEFQRRNRIYKEEQRQIRAAARKDKEGAEGGGQATHH

SEQ ID NO: 7513 - protein, 84 aa, Manihot esculenta
MASGWGITGNKGRCYDFWIDFSECMSRCREPKDCALLREDYLECLHHSKEFQRRNRIYKEEQRKIRAAARKGKESGDGVDSHHA

SEQ ID NO: 7514 - protein, 83 aa, Unknown
  Sequence found in Organisms: Gossypium hirsutum, Gossypium raimondii
MASGWGINGNKGRCYDFWVDFSECMSRCREPKDCGLLREDYLECLHHSKEFQRRNRIYKEEQRKLRAAARKDKEGENGVHHHA

SEQ ID NO: 7515 - protein, 83 aa, Heritiera littoralis
MASGWGINGNKGRCYDFWVDFSECMSRCREPKDCALLREDYLECLHHSKEFQRRNRIYKEEQRKIRAAARKDKEGEGGVHHHA

SEQ ID NO: 7516 - protein, 83 aa, Cajanus cajan
MASGWGITGNKGRCYDFWIDFSECMSRCREPKDCALLREDYLECLHHSKEFQRRNRIYKEEQRKLRAAARKGQEDGVVNEHHH

SEQ ID NO: 7517 - protein, 82 aa, Rosa hybrid cultivar
MASGWGITGNKGRCYDFWVDFSECMSRCREPKDCSLLREDYLECLHHSKEFQRRNRIYKEEQRKLRAAARAKEGGVVNDHHS

SEQ ID NO: 7518 - protein, 63 aa, Fraxinus spp
MDFSECMSRCREPKDCALLREDYFECLHHSKEFQRRNRVYKEEQRQLRAAAQKVKGGGDDGHH

SEQ ID NO: 7519 - protein, 82 aa, Acacia harpophylla
MASGWGITGNKGRCYDFWIDFSECMSRCREPKDCTLLREDYLECLHHSKEFQRRNRIYKEEQRKIRAAARQGQEGESVGGHH

SEQ ID NO: 7520 - protein, 83 aa, Brassica juncea
MASGWGITGNKGRCYDFWMDFSECMSHCREPKDCSLLRKDYLECLHHSKEFQRRNRIYKEEQRKLRAASRKGEQVVDATHTHH

SEQ ID NO: 7521 - protein, 83 aa, Brassica napus
MASGWGITGNKGRCYDFWMDFSQCMSHCREPKDCSLLREDYLECLHHSKEFQRRNRIYKEEQRKLRAASRKGEQVVDATHTHH

SEQ ID NO: 7522 - protein, 82 aa, Lotus japonicus
MASGWGITGNKGRCYDFWIDFSECMSTCREPKDCALLREDYLECLHHSKEFQRRNRIYKEEQRKLRAASRKGQDEGVVSGHH

SEQ ID NO: 7523 - protein, 84 aa, Papaver somniferum
MASGWGITGNKGRCYDFWTDFSECMSSCRQPKDCVLLREDYLECLHHAKEFQRRNRVYKEEQRQIRAAVRKAKEGEEGGVNKHH

SEQ ID NO: 7524 - protein, 82 aa, Raphanus sativus
  misc_feature (27)..(27): Xaa can be any naturally occurring amino acid
  misc_feature (77)..(77): Xaa can be any naturally occurring amino acid
MASGWGITGNKGRCYDFWMDFSECMSXCREPKDCSLLREDYLECLHHSKEFQRRNRIYKEEQRKLRAASRKGQDTGXDATHH

SEQ ID NO: 7525 - protein, 83 aa, Raphanus sativus
MASGWGITGNKGRCYDFWMDFSECMSHCREPKDCSLLREDYLECLHHSKEFQRRNRIYKEEQRKLRAASRKGEETGDASHTPH

SEQ ID NO: 7526 - protein, 84 aa, Raphanus sativus
MASGWGITGNKGRCYDFWMDFSECMSHCREPKDCSLLREDYLECLHHSKEFQRRNRIYKEEQRKLRAASRNGEQVVDATTHSHH

SEQ ID NO: 7527 - protein, 82 aa, Trigonella foenum-graecum
MASGWGITGNKGRCYDFWIDFSECMSTCREPKDCVLLREDYLECLHHSKEFQRRNRIYKEEQRKLRAAARKGQDDGKVTEHH

SEQ ID NO: 7528 - protein, 110 aa, Brassica rapa
MASGWGITGNKGRCYDFWMDFSQCMSHCREPKDCSLLREDYLECLHHSKEFQRRNRIYKEEQRKLRAASRKGEQVVDATHTHHWSPIFLQVCFFIPIPDKKNKSKILHLV

SEQ ID NO: 7529 - protein, 85 aa, Brassica rapa
MASGWGITGNKGRCYDCWMEFSECMSHCREPKDCSLLREDYLECLHHSKEFQRRNRIYKEEQRKLRAASKKGQDTGGDATHTSNH

SEQ ID NO: 7530 - protein, 92 aa, Brassica napus
SGLWIGKERDGVGWGITGNKGRCYDFWMDFSECMSHCREPKDCSLLREDYLECLHHSKEFQRRNRIYKEEQRKLRAASRKGEETGDATHTHH

SEQ ID NO: 7531 - protein, 83 aa, Gossypium hirsutum
MASGWGINGTKGRCYDFWVDFSECMSRCREPKDCSLLREDYLECLHHSKEFQRRNRIYKEEQRKIRAATRKEKDGGDGVHHHA

SEQ ID NO: 7532 - protein, 83 aa, Gossypium raimondii
MASGWGINGTKGRCYDFWVDFSECMSRCREPKDCSLLREDYLECLHHSKEFQRRNRIYKEEQRKIRAAARKEKDGGDGVHHHA

SEQ ID NO: 7533 - protein, 87 aa, Vitis vinifera
MASGWGITGSKGRCYDFWTDFSECMSRCREPKDCSLLREDYLECLHHSKEFQRRNRIYKEEQRQIRAAARKAKGEGEGEDGVQNSHH

SEQ ID NO: 7534 - protein, 85 aa, Glycyrrhiza uralensis
MASGWGITGNKGRCYDFWMDFSECMSRCREPKDCALLREDYLECLHHSKEFQRRNRVYKEEQRKLRAAARKGKEDGVVSEHHSHS

SEQ ID NO: 7535 - protein, 83 aa, Malus domestica
MASGWGITGNKGRCYDFWVDFSECMSRCREPKDCVLLREDYLECLHHSKEFQRRNRIYKEEQRKIRAAARAKEGGEVDKHHHS

SEQ ID NO: 7536 - protein, 83 aa, Unknown
  Sequence found in Organisms: Prunus persica, Prunus persica, Prunus mume
MASGWGITGNKGRCYDFWVDFSECMSRCRQPKDCVLLREDYLECLHHSKEFQRRNRIYKEEQRKIRAAARAKEGGEVDKHHHP

SEQ ID NO: 7537 - protein, 85 aa, Brassica juncea
MASGWGITGNKGRCYDFWMDFSECMSHCREPKDCSLLREDYLECLHHSKEFQRRNRIYKEEQRKLRAASKKGQDTGADATHTSNH

SEQ ID NO: 7538 - protein, 84 aa, Manihot esculenta
MASGWGITGNKGRCYDFWIDFSECMSRCREPKDCALLREDYLECLHHSKEFQRRNRIYKEEQRKIRAAARKTKDGEHGIDSHHA

SEQ ID NO: 7539 - protein, 84 aa, Chelidonium majus
MASGWGITGNKGRCYDFWTDFSECMSTCREPKDCALLREDYLECLHHAKEFQRRNRVYKEEQRQIRAAARKAKEGEGGGESNHQ

SEQ ID NO: 7540 - protein, 83 aa, Unknown
  Sequence found in Organisms: Gossypium hirsutum, Gossypium raimondii
MASGWGINGTKGRCYDFWVDFSECMSRCREPKDCALLREDYLECLHHSKEFQRRNRIYKEEQRKLRAAARKDKEGEAGVHHHG

SEQ ID NO: 7541 - protein, 82 aa, Fragaria vesca
MASGWGITGNKGRCYDFWVDFSECMSRCREPKDCSLLREDYLECLHHSKEFQRRNRIYKEEQRKIRAAARAKEGGVVNDHHS

SEQ ID NO: 7542 - protein, 294 aa, Triticum aestivum
MASRSYSNLLELAGGADRDQPLPSLGQPRIPRVMTASGIVPGLDRADAAADADADAASVASDDQPDQPPRERTIIVANQLPIRACRGADGAWEFSWDQDSLLRQLKEALRAHQGRAHMDFVYIGGLRDDIPAEEQDKVALELYDRFRCVPAFLPDDLRSRFYHGFCKQQLWPLFHYMLPLSPELGGRFDRDLWKAYLSVNKIFTDKIMEVINPEEDFVWVHDYHLMLLPTFLRKKFNRVRLGFFLHSPFPSSEIYKTLPVREEVLRALLNADLIGFPHLIMPGISSHAAAGCWE

SEQ ID NO: 7543 - protein, 897 aa, Secale cereale
MASRSYANLMELAGGADRDQPLPSLGQPRVPRVMTASGIVPGLDCSGAAADAASVDSDDQSNQAPRERTILVANQLPIRACRGADGAWDFSWDQDSLLRQLKESLRAHQGRAHMDFVYIGCLRDDIPAEEQDKVALELYERFRCVPTFLPDDLRSRFYHGFCKQQLWPLFHYMLPLSPELGGRFDRNLWQAYLSVNKIFTDKILEVINPEEDFVWVHDYHLMVLPTFLRKKFNRVRLGFFLHSPFPSSEIYKTLPVREEVLRALLNADLIGFHTFDYARHFLSCCSRMLGMKYESQRGYIALEYYGRTVTVKILPVGIHLVQLQAVLNLPDTELKVAELMKEFCDRDRIMMLGVDDMDIFKGISLKLLAFEQLLMEHPKWRGKVVLVQIANPARGKGKDVKEVQDESYAMVKRINETFGRPDYQPVILIDRPLHFYERMAYYVVAECCLVTAVRDGMNLIPYEYIIARQGNAKIDRILGLSPFTRKKSMLVVSEFIGCSPSLSGAIRVNPWNIESVAEAMERALHTGDDEKALRHEKHHKFVSTHDVGYWANSFLQDLERSCQDHNKRRCWGIGFGLRFRVVALDTSFKKLAFEQLVSAYRKASTRVILLDYDGTLMPQSSFGKMPSSRTIDMLNSLSRDEKNMVLLASTKTRATLSGWFSRCEDLGLAAEHGFFIRPNRDAEWETCGLATDFSWKQIAEPVMKTYTETTDGSIIEEKETAIVWCYKDADRDFGSCQAKELHEHLESVLSNEPVSVKADLNYVEVKPQGVSKGLVAKWMLSTMQAGGFLPDFILCVGDDCSDEDMFEVITTAVDGPYLDPAATVFACTVGRKPSKAKYYLDEPDDIKRLIRALASVSDQELEELEDLEEGDDDDSPYPFLAGDDEDDGTSTDDTWLS

SEQ ID NO: 7544 - protein, 897 aa, Secale cereale
MASRSYANLMELAGGADRDQPLPSLGQPRVPRVMTASGIVPGLDCSGAAADATSVDSDDQSNQAPRERTILVANQLPIRACRGADGAWEFSWDQDSLLRQLKESLRAHQGRAHMDFVYIGCLRDDIPAEEQDKVALELYERFRCVPTFLPDDLRSRFYHGFCKQQLWPLFHYMLPLSPELGGRFDRNLWQAYLSVNKIFTDKILEVINPEEDFVWVHDYHLMVLPTFLRKKFNRVRLGFFLHSPFPSSEIYKTLPVREEVLRALLNADLIGFHTFDYARHFLSCCSRMLGMKYESQRGYIALEYYGRTVTVKILPVGIHLVQLQAVLNLPDTELKVAELMKEFCDRDRIMMLGVDDMDIFKGISLKLLAFEQLLKEHPKWRGKVVLVQIANPARGKGKDVKEVQDESYAMVKRINETFGRPDYQPVILIDRPLHFYERMAYYVVAECCLVTAVRDGMNLIPYEYIIARQGNAKIDRILGLSPFTRKKSMLVVSEFIGCSPSLSGAIRVNPWNIESVAEAMERALHTGDDEKALRHEKHHKFVSTHDVGYWANSFLQDLERSCQDHNKRRCWGIGFGLRFRVVALDTSFKKLAFEQLVSAYRKASTRVILLDYDGTLMPQSSFGKMPSSRTIDMLNSLSRDEKNMVLLASTKTRATLSGWFSRCEDLGLAAEHGFFIRPNRDAEWETCGLATDFSWKQIAEPVMKTYTETTDGSIIEEKETAIVWCYKDADRDFGSCQAKELHEHLESVLSNEPVSVKADLNYVEVKPQGVSKGLVAKWMLSTMQAGGFLPDFILCVGDDCSDEDMFEVITTAVDGPYLDPAATVFACTVGRKPSKAKYYLDEPDDIKRLIRALASVSDQELEELEDLEEGDDDDSPYPFLAGDDDDDGTSTDDTWLS

SEQ ID NO: 7545 - protein, 767 aa, Secale cereale
MASRSYANLMELAGGADRDQPLPSLGQPRVPRVMTASGIVPGLDCSGAAADAASVDSDDQSNQAPRERTILVANQLPIRACRGADGAWDFSWDQDSLLRQLKESLRAHQGRAHMDFVYIGCLRDDIPAEEQDKVALELYERFRCVPTFLPEDLRSRFYHGFCKQQLWPLFHYMLPLSPELGGRFDRNLWQAYLSVNKIFTDKILEVINPEEDFVWVHDYHLMVLPTFLRKKFNRVRLGFFLHSPFPSSEIYKTLPVREEVLRALLNADLIGFHTFDYARHFLSCCSRMLGMKYESQRGYIALEYYGRTVTVKILPVGIHLVQLQAVLNLPDTELKVAELMKEFCDRDRIMMLGVDDMDIFKGISLKLLAFEQLLMEHPKWRGKVVLVQIANPARGKGKDVKEVQDESYAMVKRINETFGRPDYQPVILIDRPLHFYERMAYYVVAECCLVTAVRDGMNLIPYEYIIARQGNAKIDRILGLSPFTRKKSMLVVSEFIGCSPSLSGAIRVNPWNIESVAEAMERALHTGDDEKALRHEKHHKFVSTHDVGYWANSFLQDLERSCQDHNKRRCWGIGFGLRFRVVALDTSFKKLAFEQLVSAYRKASTRVILLDYDGTLMPQSSFGKMPSSRTIDMLNSLSRDEKNMVLLASTKTRATLSGWFSRCEDLGLAAEHGFFIRPNRDAEWETCGLATDFSWKQIAEPVMKTYTETTDGSIIEGKGDSNRVVLTKDRRPCSFGFFDQRRRSLHEPPWRAVPFTNDGRSSVQSST

SEQ ID NO: 7546 - protein, 263 aa, Unknown
  Sequence found in Organisms: Hordeum vulgare, Leymus cinereus x Leymus triticoides
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWACQVVLMGFIEGYRVGGGPLGEGLDIIYPGGAFDPLGLADDPDTAAELKVKELKNGRLAMFSMFGFFVQAIVTGKGPVENLFDHIADPVNNNAWAFATNFAPGS

SEQ ID NO: 7547 - protein, 263 aa, Unknown
  Sequence found in Organisms: Secale cereale, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFAPGS

SEQ ID NO: 7548 - protein, 263 aa, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGVQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFAPGS

SEQ ID NO: 7549 - protein, 263 aa, Leymus cinereus x Leymus triticoides
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHIADPVNNNAWAFATNFAPGS

SEQ ID NO: 7550 - protein, 263 aa, Lolium multiflorum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWATQVVLMGFIEGYRVGGGPLGEGLDKIYPGGSFDPLGLADDPDTAAELKVKELKNGRLAMFSMFGFFVQAIVTGKGPIENLFDHVADPVNNNAWAFATNFAPGS

SEQ ID NO: 7551 - protein, 263 aa, Avena sativa
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWATQVVLMGFIEGYRVGGGPLGEGLDQIYPGGAFDPLGLADDPDTAAELKVKELKNGRLAMFSMFGFFVQAIVTGKGPIENLFDHVADPVNNNAWAFATNFAPGS

SEQ ID NO: 7552 - protein, 96 aa, Secale cereale
MAASALHQTTSFLGTAPRRDDLVRSVGDFGGRITMRRTVKSAPQSIWYGPDRPKYLGPFSEQTPSYLTGEFPGDYGWDTAGLSADPETFARTGSWR

SEQ ID NO: 7553 - protein, 263 aa, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFPPGS

SEQ ID NO: 7554 - protein, 169 aa, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNREAGGDPLAVGDARRPGVRVPGDPVQERHQVRRGRVVQGRRPDLLRGRPRLPGQPQPGARAEHPGHLGGSGGAHGLH

SEQ ID NO: 7555 - protein, 263 aa, Avena sativa
MAASALHQTTSFLGAAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWATQVVLMGFIEGYRVGGGPLGEGLDQIYPGGAFDPLGLADDPDTAAELKVKELKNGRLAMFSMFGFFVQAIVTGKGPIENLFDHIADPVNNNAWAFATNFAPGS

SEQ ID NO: 7556 - protein, 266 aa, Secale cereale
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFAPELNVF

SEQ ID NO: 7557 - protein, 266 aa, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFAPEAKCV

SEQ ID NO: 7558 - protein, 210 aa, Secale cereale
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYRGQPQPGARADASWPVWAVQVVLMGFIEGYALAAAPSAGPRHHLPGRRLSTRFGPRRRPPTPPPSSR

SEQ ID NO: 7559 - protein, 263 aa, Oryza sativa
MAASALHQTTSFLGTAPRRDELVRRVGDSGGRITMRRTVKSAPQSIWYGPDRPKYLGPFSEQTPSYLTGEFPGDYGWDTAGLSADPETFARNRELEVIHSRWAMLGALGCVFPEILSKNGVKFGEAVWFKAGAQIFSEGGLDYLGNPNLVHAQSILAIWAVQVVLMGFVEGYRVGGGPLGEGLDKVYPGGAFDPLGLADDPDTFAELKVKELKNGRLAMFSMFGFFVQAIVTGKGPIENLFDHVADPVANNAWAYATNFVPGK

SEQ ID NO: 7560 - protein, 261 aa, Panicum virgatum
MAASALHQTTSFLGQALVSRPAGGADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGK

SEQ ID NO: 7561 - protein, 260 aa, Zea mays
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 7562 - protein, 260 aa, Pennisetum glaucum
MAASALHQTTSFLGQALVSRPAAADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGK

SEQ ID NO: 7563 - protein, 261 aa, Setaria italica
MAASALHQTTSFLGQALVSRPAAAADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGK

SEQ ID NO: 7564 - protein, 262 aa, Sorghum bicolor
MAASALHQTTSFLGQALVSRPAAAAADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 7565 - protein, 207 aa, Panicum virgatum
MAASALHQTTSFLGQALVPRPAGAGADAGGRITMRRTVKSAPQSIWYGPDRPKYLGPFSEQTPSYLTGEFPGDYGWDTAGLSADPETFARNRELEVFHSRWAMLGALGCVFPEILAKNGVKFGEAVWFKAGAQIFSEGGLDYLGNPNLVTRRASWPSGLARWCSWASSRATASAAGRSGRGSTRCTRAAPSTRWGSPTTRTPPRSSR

SEQ ID NO: 7566 - protein, 72 aa, Panicum virgatum
MLWGALFTVRRMVMRPPASAPAPAGRGTRACPRKLVVWCSADAAIFGSARVSGEIVRPIERWWMGMAGAGEE

SEQ ID NO: 7567 - protein, 259 aa, Cynodon dactylon
MATSALQQTTSFLGQALVSRVGVDAGGRITMRRTVKSAPQSIWYGPDRPKYLGPFSEQTPSYLTGEFPGDYGWDTAGLSADPETFARNRELEVIHCRWAMLGALGCVFPEILAKNGVKFGEAVWFKAGAQIFSEGGLDYLGNPNLVHAQSILAIWAVQVVLMGFVEGYRVGGGPLGEGLDKIYPGGAFDPLGLADDPDTAAELKVKEIKNGRLAMFSMFGFFVQAIVTGKGPIENLFDHVNDPVANNAWAYATNFVPGK

SEQ ID NO: 7568 - protein, 258 aa, Eragrostis curvula
MAASALQQTTSFLGQALVSRVGVDAGGRITMRRTSERAQSIWYGPDRPKYLGPFSEQTPSYLTGEFPGDYGWDTAGLSADPETFARNRELEVIHARWAMLGALGCVFPEILAKNGVKFGEAVWFKAGAQIFSEGGLDYLGNPNLVHAQSILAIWAVQVVLMGFVEGYRVGGGPLGEGLDKVYPGGAFDPLGLADDPDTAAELKVKEIKNGRLAMFSMFGFFVQAIVTGKGPIENLFDHVNDPVANNAWAYATNFVPGK

SEQ ID NO: 7569 - protein, 260 aa, Elaeis guineensis
MAASALHQTTSFLGQALVSRPAAAADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGRARQGVPGGAFDPLGLADDPDTAAELKVKELKNGRLAMFSMFGFFVQAIVTGKGPIENLFDHVADPVANNAWAYATNFVPGK

SEQ ID NO: 7570 - protein, 266 aa, Antirrhinum majus
MATSAIQQSAFGGQTALKPKNELIRKVGNLGTGGRFTMRRTVKSAPQSIWYGPDRPKYLGPFSEQTPSYLTGEFPGDYGWDTAGLSADPETFAKNRELEVIHSRWAMLGALGCVFPEILSRNGVKFGEAVWFKAGSQIFSEGGLDYLGNPNLVHAQSILAIWAVQVVLMGFVEGYRVGGGPLGEGLDKIYPGGAFDPLGLADDPEAFAELKVKELKNGRLAMFSMFGFFVQAIVTGKGPVENLFDHVADPVANNAWAFATNFVPGK

SEQ ID NO: 7571 - protein, 264 aa, Aristolochia fimbriata
MAASAIQQSAFAGQTALKQRDELVRKVGVFDGRISMRRTVKSAPQSIWYGPDRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWACQVVLMGFVEGYRVGGGPLGEGLDAIYPGGAFDPLGLADDPEAFAELKVKEIKNGRLAMFSMFGFFVQAIVTGKGPIENLSDHIADPVANNAWAYATNFVPGK

SEQ ID NO: 7572 - protein, 265 aa, Cucurbita pepo
MATSAIQQSAFAGQTALKQSNELVRKVGAFGGSRFTMRRTVKSAPQSIWYGADRPKYLGPFSEQTPSYLTGEFPGDYGWDTAGLSADPETFAKNRELEVIHSRWAMLGALGCVFPEILAKNGVKFGESVWFKAGSQIFSEGGLDYLGNPNLIHAQSILAIWACQVVLMGFVEGYRVGGGPLGEGLDPIYPGGAFDPLGLADDPDAFAELKVKELKNGRLAMFSMFGFFVQAIVTGKGPVENLFDHVADPVANNAWAYATNFVPGK

SEQ ID NO: 7573 - protein, 265 aa, Actinidia deliciosa
MATSAIQHAAFAGQTALSRQNEFFRKVGPIGGTRFTMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLVHAQSILAIWACQVVLMGFVEGYRVGGGPLGEGLDKIYPGGAFDPLGLADDPEAFAELKVKELKNGRLAMFSMFGFFVQAIVTGKGPIENLSDHLADPVANNAWAYATNFVPGK

SEQ ID NO: 7574 - protein, 264 aa, Liriodendron tulipifera
MATSAIQRSAFAGQTVLKPQNELVRKVGVFEGRISMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWACQVVLMGFIEGYRVGGGPLGEGLDAIYPGGAFDPLGLADDPEAFAELKVKEIKNGRLAMFSMFGFFVQAIVTGKGPIENLFDHLADPVANNAWAYATNFVPGK

SEQ ID NO: 7575 - protein, 265 aa, Cucumis sativus
MATSAIQQSAFAGQTALKQSNELVRKVGALGGARFTMRRTVKSAPQSIWYGPDRPKYLGPFSEQTPSYLTGEFPGDYGWDTAGLSADPETFAKNRELEVIHSRWAMLGALGCVFPELLAKNGVKFGESVWFKAGSQIFSEGGLDYLGNPNLIHAQSILAIWACQVVLMGFVEGYRVGGGPLGEGLDPIYPGGAFDPLGLADDPDAFAELKVKELKNGRLAMFSMFGFFVQAIVTGKGPIENLFDHVADPVANNAWAYATNFVPGK

SEQ ID NO: 7576 - protein, 265 aa, Flaveria ramosissima
MATSAIQQSAFAGSAALKPQNELVKKTGSFNGGRFTMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKGPIENLFDHVSDPVANNAWAYATNFVPGK

SEQ ID NO: 7577 - protein, 265 aa, Populus trichocarpa
MAASAIQQSAFAGQTALKQPNDLVRKVGSFGGGRVTMRRTVKSAPQSIWYGPDRPKFLGPFSEQTPSYLTGEFPGDYGWDTAGLSADPETFAKNRELEVIHSRWAMLGALGCVFPEILAKNGVKFGESVWFKAGAQIFSEGGLDYLGNPNLIHAQSILAIWASQVVLMGFVEGYRVGGGPLGEGLDPIYPGGAFDPLGLADDPDAFAELKVKELKNGRLAMFSMFGFFVQAIVTGKGPVENLLDHLADPVANNAWAYATNFVPGK

SEQ ID NO: 7578 - protein, 265 aa, Camellia sinensis
MATSAIQQSAFAGQTALKPQNELVRKIGSFGGGRITMRRTVRSAPQSIWYGPDRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLIHAQSILAIWACQVVLMGFIEGYRVGGGPLGEGLDKIYPGGAFDPLGLADDPEAFAELKVKEIKNGRLAMFSMFGFFVQAIVTGKGPIENLFDHLADPVANNAWAYATNFVPGK

SEQ ID NO: 7579 - protein, 236 aa, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGRGP

SEQ ID NO: 7580 - protein, 265 aa, Populus trichocarpa
MAASAIQQSAFAGQTALKQPNDLVRKVGSFGGGRVTMRRTVKSAPQSIWYGPDRPKFLGPFSEQTPSYLTGEFPGDYGWDTAGLSADPETFAKNRELEVIHSRWAMLGALGCVFPEILAKNGVKFGESVWFKAGAQIFSEGGLDYLGNPNLIHAQSILAIWASQVVLMGFVEGYRVGGGPLGEGLDPLYPGGAFDPLGLADDPDAFAELKVKELKNGRLAMFSMFGFFVQAIVTGKGPVENLLDHLADPVANNAWAYATNFVPGK

SEQ ID NO: 7581 - protein, 265 aa, Ambrosia trifida
MATSAIQQSAFAGQAALKPQNELVRKTGSFNGGRYTMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7582 - protein, 266 aa, Cannabis sativa
MATSAIQQSAFAGQTALKQSNELVRKVGGGSSGGRATMRRTVKSAPQSIWYGPDRPKYLGPFSEQIPSYLNGEFPGDYGWDTAGLSADPETFARNRELEVIHSRWAMLGALGCVFPEILSKNGVKFGEAVWFKAGSQIFSEGGLDYLGNPNLVHAQSILAIWATQVVLMGFVEGYRVGGGPLGEGLDPIYPGGAFDPLGLADDPDAFAELKVKELKNGRLAMFSMFGFFVQAIVTGKGPVENLFDHLADPVTNNAWAYATNFVPGK

SEQ ID NO: 7583 - protein, 265 aa, Unknown
  Sequence found in Organisms: Castanea mollissima, Quercus alba
MASSTIQRSAFAGQTALKQSNELVRKVGSFAGGRVTMRRTVKSAPQSIWYGPDRPKYLGPFSEQTPSYLTGEFPGDYGWDTAGLSADPETFARNRELEVIHSRWAMLGALGCVFPEVLSKNGVKFGEAVWFKAGAQIFSEGGLDYLGNPNLIHAQSILAIWAVQVVLMGFIEGYRVGGGPLGEGLDPIYPGGAFDPLGLADDPEAFAELKVKELKNGRLAMFSMFGFFVQAIVTGKGPIENLFDHVADPVANNAWAYATNFVPGK

SEQ ID NO: 7584 - protein, 265 aa, Eschscholzia californica
MATSAIQQSTFAGQTALKSRNELVRKVGDFGGRISMRRTVKKSVSESIWYGEDRPKYLGPFSEQTPSYLTGEFPGDYGWDTAGLSADPETFAKNRELEVIHSRWAMLGALGCVFPEILSKNGVQFGEAVWFKAGSQIFSEGGLDYLGNPNLVHAQSILAIWAVQVVLMGFVEGYRVGGGPLGEGLDKIYPGGAFDPLGLADDPESFSELKVKEIKNGRLAMFSMFGFFVQAIVTGKGPVENLFDHLADPATNNAWAYATNFVPGK

SEQ ID NO: 7585 - protein, 265 aa, Flaveria ramosissima
MATSAIQQSAFAGSAALKPQNELVKKTGSFNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKGPIENLFDHVSDPVANNAWAYATNFVPGK

SEQ ID NO: 7586 - protein, 265 aa, Flaveria ramosissima
MATSAIQQSAFAGSAALKPQNELVKKIGSFNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKGPIENLFDHVSDPVANNAWAYATNFVPGK

SEQ ID NO: 7587 - protein, 265 aa, Vitis vinifera
MATSAIQRSAFAGQTALKQPNELVRKVGGLGGGRITMRRTVKSTPQSIWYGPDRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWACQVVLMGFVEGYRVGGGPLGEGLDAIYPGGAFDPLGLADDPDAFAELKVKEIKNGRLAMFSMFGFFVQAIVTGKGPIENLVDHLADPVANNAWAYATNFVPGK

SEQ ID NO: 7588 - protein, 265 aa, Jatropha curcas
MATSAIQQSAFAGQTALKQSNELVRKVGSFGGGRITMRRTVKSAPQSIWYGPDRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLIHAQSILAIWAVQVVLMGFVEGYRVGGGPLGEGLDPIYPGGAFDPLGLADDPDAFAELKVKEIKNGRLAMFSMFGFFVQAIVTGKGPIENLSDHLADPVANNAWAYATNFVPGK

SEQ ID NO: 7589 - protein, 265 aa, Cucumis melo
MATSAIQQSAFAGQAALKQSNELVRKVGAVGGSRFTMRRTVKSAPQSIWYGPDRPKYLGPFSEQTPSYLTGEFPGDYGWDTAGLSADPETFAKNRELEVIHSRWAMLGALGCVFPELLAKNGVKFGESVWFKAGSQIFSEGGLDYLGNPNLIHAQSILAIWACQVVLMGFVEGYRVGGGPLGEGLDPIYPGGAFDPLGLADDPDAFAELKVKELKNGRLAMFSMFGFFVQAIVTGKGPIENLFDHVADPVANNAWAYATNFVPGK

SEQ ID NO: 7590 - protein, 265 aa, Citrus sinensis
MATSAIQQSAFAGQTALRQSNEFVRKVGVADGGRITMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGAQIFSEGGLDYLGNPNLIHAQSILAIWACQVVLMGFVEGYRIGGGPLGEGLDPLYPGGAFDPLGLADDPDQFAELKVKELKNGRLAMFSMFGFFVQAIVTGKGPIENLYDHIADPVANNAWAYATNFVPGK

SEQ ID NO: 7591 - protein, 265 aa, Carica papaya
MATSAIQQSAFAGQTALKQANELVHKVGAFGGGRATMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGSQIFSEGGLDYLGNPNLIHAQSILAIWACQVVLMGFVEGYRVGGGPLGEGLDPIYPGGAFDPLGLADDPEAFAELKVKEIKNGRLAMFSMFGFFVQAIVTGKGPIENLFDHVADPVANNAWAYATNFVPGK

SEQ ID NO: 7592 - protein, 265 aa, Tripterygium wilfordii
MATSAIQQSAFAGQTALKQPNEFVRRVGSFGGGRISMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWASQVVLMGFVEGYRIGGGPLGEGLDPLYPGGAFDPLGLADDPEAFAELKVKELKNGRLAMFSMFGFFVQAIVTGKGPIENLFDHVADPVANNAWAYATNFVPGK

SEQ ID NO: 7593 - protein, 265 aa, Populus trichocarpa
MATSAIQQSAFAGQTALKQSNELVRKVGSSGDGRITMRRTVKSAPQSIWYGPDRPKYLGPFSEQTPSYLTGEFPGDYGWDTAGLSADPETFAKNRELEVIHSRWAMLGALGCVFPEILAKNGVKFGESVWFKAGSQIFSEGGLDYLGNPNLIHAQSILAIWASQVVLMGFVEGYRVGGGPLGEGLDPIYPGGAFDPLGLADDPDAFAELKVKELKNGRLAMFSMFGFFVQAIVTGKGPIENLLDHLADPVANNAWAYATNFVPGK

SEQ ID NO: 7594 - protein, 261 aa, Scabiosa columbaria
MATSAIQHSGLALKPQNELVRKVGSFGTSRLNMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWASQVVLMGLIEGYRVGGGPLGEGLDSLYPGGAFDPLGLADDPEAFAELKVKELKNGRLAMFSMFGFFVQAIVTGKGPVENLYDHVADPVANNAWAYATNFVPGK

SEQ ID NO: 7595 - protein, 261 aa, Scabiosa columbaria
MATSAIQHSGLALKPQNELVRKVGSFGSSRLNMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWASQVVLMGLIEGYRVGGGPLGEGLDSLYPGGAFDPLGLADDPEAFAELKVKELKNGRLAMFSMFGFFVQAIVTGKGPVENLYDHVADPVANNAWAYATNFVPGK

SEQ ID NO: 7596 - protein, 265 aa, Citrus clementina
MATSAIQQSAFAGQTALRQSNEFVRKVGVADGGRITMRRTVKSTPQSIWYGPDRPKYLGPFSEQTPSYLTGEFPGDYGWDTAGLSADPETFAKNRELEVIHSRWAMLGALGCVFPEILSKNGVKFGEAVWFKAGAQIFSEGGLDYLGNPNLIHAQSILAIWACQVVLMGFVEGYRIGGGPLGEGLDPLYPGGAFDPLGLADDPDQFAELKVKELKNGRLAMFSMFGFFVQAIVTGKGPIENLYDHIADPVANNAWAYATNFVPGK

SEQ ID NO: 7597 - protein, 266 aa, Sesamum indicum
MATSAFQQSAFGGQTALKPQNELIRKVGNVSAGGRFTMRRTVKSAPQSIWYGPDRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLIHAQSILAIWACQVVLMGFVEGYRVGGGPLGEGLDKIYPGGAFDPLGLADDPEAFAELKVKEIKNGRLAMFSMFGFFVQAIVTGKGPIENLFDHVADPVANNAWAYATNFVPGK

SEQ ID NO: 7598 - protein, 267 aa, Flaveria ramosissima
MATSAIQQSAFAGSAALKPQNELVKKIGSFNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKMDDWLCFRCSGSSFRPSLLEKARSRTCLIMSAIRWLTTLGLMPPTLFLENEF

SEQ ID NO: 7599 - protein, 68 aa, Flaveria ramosissima
MATSAIQQSAFAGSAALKPQNELVKKIGSFNGGRSPCAEPSRAHHKAFGMGRTGPSTWARSRSKPHHT

SEQ ID NO: 7600 - protein, 270 aa, Quercus alba
MASSTIQRSAFAGQTALKQSNELVRKVGSFAGGRVTMRRTVKSAPQSIWYGPDRPKYLGPFSEQTPSYLTGEFPGDYGWDTAGLSADPETFARNRELEVIHSRWAMLGALGCVFPEVLSKNGVKFGEAVWFKAGAQIFSEGGLDYLGNPNLIHAQSILAIWAVQVVLMGFIEGYRVGGGPLGEGLDPIYPGGAFDPLGLADDPEAFAELKVKELKNGRLAMFSMFGSLFRLLLLERVQLRTCLTMLLTQSPTMHGPTPLTLSLENEETLL

SEQ ID NO: 7601 - protein, 208 aa, Quercus alba
MASSTIQRSAFAGQTALKQSNELVRKVGSFAGGRVTMRRTVKSAPQSIWYGPDRPKYLGPFSEQTPSYLTGEFPGDYGWDTAGLSADPETFARNRELEVIHSRWAMLGALGCVFPEVLSKNGVKFGEAVWFKAGAQIFSEGGLDYLGNQTSFMHKAFWQSGLFKLCLWASLKDTELVEDHSVKDLTPFTLVVPLTHLDWLMILKHSQN

SEQ ID NO: 7602 - protein, 265 aa, Unknown
  Sequence found in Organisms: Prunus persica, Prunus persica
MATSAIQQSAFAGQTALKQSNELIRKIGGLGGGRITMRRTVKSTPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLVHAQSILAIWAVQVVLMGFVEGYRVGGGPLGEGLDPLYPGGAFDPLGLADDPEAFAELKVKELKNGRLAMTSMFGFFVQAIVTGKGPVENLYDHVADPVANNAWAYATNFVPGK

SEQ ID NO: 7603 - protein, 265 aa, Prunus mume
MATSAIHQSAFAGQTALKQSNELIRKIGGLGGGRITMRRTVKSTPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLVHAQSILAIWAVQVVLMGFVEGYRIGGGPLGEGLDPLYPGGAFDPLGLADDPEAFAELKVKELKNGRLAMTSMFGFFVQAIVTGKGPVENLYDHVADPVANNAWAYATNFVPGK

SEQ ID NO: 7604 - protein, 265 aa, Ambrosia trifida
MATSAIQQSAFAGQAALKPQNELVRKTGSFNGGRFTMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEDGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFMPGK

SEQ ID NO: 7605 - protein, 265 aa, Ambrosia trifida
MATSAIQQSAFAGQAALKPQNELARKTGSFNGGRFTMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7606 - protein, 265 aa, Malus domestica
MATSAIQRSAFAGQTVLKQSNELVRKIGGLGGGRFSMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWAVQVVLMGFIEGYRVGGGPLGEGLDPLYPGGAFDPLGLADDPEAFAELKVKELKNGRLAMTSMFGFFVQAIVTGKGPVENLFDHIADPVANNAWAFATNFVPGK

SEQ ID NO: 7607 - protein, 265 aa, Catharanthus roseus
MATSGLQQSTFAGQTLLKPQNELIRKVGTVGGGRFTMRRTVKSVPQSIWYGPDRPKYLGPFSEQTPSYLTGEFPGDYGWDTAGLSADPETFAKNRELEVIHSRWAMLGALGCVFPEILAKNGVKFGEAVWFKAGAQIFSEGGLDYLGNPNLIHAQSILAIWACQVVLMGLIEGYRVGGGPLGEGLDKIYPGGAFDPLGLADDPEAFAELKVKEIKNGRLAMFSMFGFFVQAIVTGKGPIENLFDHVADPVANNAWAYATNFVPGK

SEQ ID NO: 7608 - protein, 265 aa, Flaveria ramosissima
MATSAIQQSAFTSQPALKPQNELVKKTGDFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7609 - protein, 265 aa, Fraxinus spp
MATSAIQQSAFAGQTALKSQNQLIRKVGNLRGGRFTMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLIHAQSILAIWACQVVLMGFVEGYRVGGGPLGEGLDKIYPGGAFDPLGLADDPEAFAELKVKEIKNGRLAMFSMFGFFVQAIVTGKGPIENLFDHVADPVANNAWAYATNFVPGK

SEQ ID NO: 7610 - protein, 265 aa, Allium cepa
MAASAIQQSSFAGQTALKTSNDLLRKVNLSGNGRFTMRRTVKSAPQSIWYGPDRPKYLGPFSEQTPSYLTGEFPGDYGWDTAGLSADPETFAKNRELEVIHCRWAMLGALGCVFPEVLSKNGVKFGEAVWFKAGSQIFSEGGLDYLGNPNLVHAQSILAIWAVQVVLMGFIEGYRVGGGPLGEGLDALYPGGAFDPLGLADDPDAFAELKVKEIKNGRLAMTSMFGFFVQAIVTGKGPVENLFDHLDNPTANNAWAFATNFVPGK

SEQ ID NO: 7611 - protein, 265 aa, Populus trichocarpa
MATSAIQQSAFAGQTALKQSNELVRKVGSSGDGRITMRRTVKSAPQSIWYGPDRPKYLGPFSEQTPSYLTGEFPGDYGWDTAGLSADPETFAKNRELEVIHSRWAMLGALGCVFPEILAKNGVKFGESVWFKAGSQIFSEGGLDYLGNPNLIHAQSILAIWASQVVLMGFVEGYRVGGGPLGEGLDPIYPGGAFDPLGLADDPDAFAELKVKELKNGRLAMFSMFGFFVQAIITGKGPIENLLDHLADPVANNAWAYATNFVPGK

SEQ ID NO: 7612 - protein, 265 aa, Primula obconica
MATSAIQQSAFAGQTGLKAQNELVRKVGSFGGDRATMRRTVKSTSQSIWYGEDRPKYLGQFSEQTPSYLTGEFPGDYGWDTAGLSADPETFAKNRELEVIHSRWAMLGALGCVFPEILSKNGVKFGEAVWFKAGSQIFSEGGLDYLGNPNLVHAQSILAIWASQVVLMGFVEGYRVGGGPLGEGLDKIYPGGSFDPLGLADDPEAFSELKVKELKNGRLAMFSMFGFFVQAIVTGKGPVENLYDHLADPVANNAWAFATNFAPGK

SEQ ID NO: 7613 - protein, 265 aa, Helianthus annuus
MATSAIQQSAFAGQAALKPQNELLRKTGSFNGGRFTMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7614 - protein, 265 aa, Nicotiana tabacum
MATSAIQQSAFSGQTALKSQNELVRKIGSFNGGRATMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLIHAQSILAIWASQVVLMGLIEGYRVGGGPLGEGLDKIYPGGAFDPLGLADDPEAFAELKVKEIKNGRLAMFSMFGFFVQAIVTGKGPIENLFDHIADPVANNAWAFATNFVPGK

SEQ ID NO: 7615 - protein, 265 aa, Nicotiana tabacum
MATSAIQQSAFAGQTALKSQNELVRKIGSFNGGRATMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLIHAQSILAIWASQVVLMGLIEGYRVGGGPLGEGLDKIYPGGAFDPLGLADDPEAFAELKVKEIKNGRLAMFSMFGFFVQAIVTGKGPIENLFDHVADPVANNAWAYATNFVPGK

SEQ ID NO: 7616 - protein, 232 aa, Flaveria ramosissima
MRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKARSRTCLIMSAIRWLTTLGLMLPTLFLEMSLI

SEQ ID NO: 7617 - protein, 267 aa, Quercus alba
MATSTIQRSAFAGHTHTALKQSNDFIRKVGGFGGGRVTMRRTVKSAPQSIWYGPDRPKYLGPFSEQTPSYLTGEFPGDYGWDTAGLSADPETFARNRELEVIHSRWAMLGALGCVFPEILSKNGVKFGEAVWFKAGAQIFSEGGLDYLGNPNLIHAQSILAIWAVQVVLMGFIEGYRVGGGPLGEGLDPIYPGGAFDPLGLADDPEAFAELKVKELKNGRLAMFSMFGFFVQAIVTGKGPIENLFDHVADPVANNAWAYATNFVPGK

SEQ ID NO: 7618 - protein, 96 aa, Flaveria ramosissima
MATSAIQQSAFAGSAALKPQNELVKKTGSFNGGRFTMRRTVKSAPQSIWVWAGTGPSTWARFSEQTPSYLTGEFPGDYGWDTAGLSADPETFVQEP

SEQ ID NO: 7619 - protein, 265 aa, Olea europaea
MATSAIQQSAFAGQTALKSQNQLIRKVGNLGGGRFTMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLIHAQSILAIWACQVVLMGFVEGYRVGGGPLGEGLDKIYPGGAFDPLGLADDPEAFAELKVKEFKNGRLAMFSMFGFFVQAIVTGKGPIENLFDHIADPVANNAWAYATNFVPGK

SEQ ID NO: 7620 - protein, 265 aa, Ambrosia trifida
MATSAIQQSAFSGQAALKPLNELVRKTGSVNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7621 - protein, 265 aa, Malus domestica
MATSAIQQSAFAGQTALKQSSELVRKIGGLGGGRFSMRRTVKSAPQSIWYGPDRPKYLGPFSEQTPSYLTGEFPGDYGWDTAGLSADPETFAKNRELEVIHSRWAMLGALGCVFPEILSRNGVKFGEAVWFKAGSQIFSEGGLDYLGNPNLIHAQSILAIWAVQVVLMGFIEGYRVGGGPLGEGLDPLYPGGAFDPLGLADDPEAFAELKVKELKNGRLAMTSMFGFFVQAIVTGKGPVENLFDHIADPVANNAWAYATNFVPGK

SEQ ID NO: 7622 - protein, 265 aa, Artemisia annua
MATSAIQQAAFAGQSALKPQNELVRKVGGFHGGRYTMRRTVKSAPQSIWYGPDRPKYLGPFSEQTPSYLTGEFPGDYGWDTAGLSADPETFAKNRELEVIHSRWAMLGALGCVFPEVLSKNGVKFGEAVWFKAGSQIFSEGGLDYLGNPNLIHAQSILAIWASQVVLMGLIEGYRVGGGPLGEGLDSIYPGGSFDPLGLADDPEAFAELKVKELKNGRLAMFSMFGFFVQAIVTGKGPIENLFDHLADPAANNAWAYATNFVPGK

SEQ ID NO: 7623 - protein, 264 aa, Chelidonium majus
MATSAINQSAFAGQTALKQQNELVRKVGTFGGRISMRRTVKSTPESIWYGPDRPKYLGPFSEQTPSYLTGEFPGDYGWDTAGLSADPETFAKNRELEVIHSRWAMLGALGCVFPEVLSKNGVTFGEAVWFKAGSQIFSEGGLDYLGNPNLVHAQSILAIWASQVVLMGLIEGYRVGGGPLGEGLDQIYPGGSFDPLGLADDPEAFAELKVKELKNGRLAMFSMFGFFVQAIVTGKGPIENLYDHLADPVANNAWAYATNFVPGK

SEQ ID NO: 7624 - protein, 265 aa, Unknown
  Sequence found in Organisms: Gossypium hirsutum, Gossypium raimondii
MATSAIQQSAFVGQTALKQSNELLRKVGAFDGGRVTMRRTVKSAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 7625 - protein, 265 aa, Gossypium hirsutum
MATSAIQQSTFVGQTALKQSNELLRKVGAFNGGRVTMRRTVKNAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 7626 - protein, 265 aa, Gossypium hirsutum
MATSAIQQSAFVGQTALKQSNELLRKVGAFNGGRVTMRRTVKSAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFDPGK

SEQ ID NO: 7627 - protein, 264 aa, Taraxacum officinale
MASSAIQQSAFTGQQALKPQNELVRKTGNFNGGTITMRRTVKSAPQSIWYGPDRPKYLGPFSEQTPSYLTGEFPGDYGWDTAGLSADPETFAKNRELEVIHSRWAMLGALGCVFPELLSKNGVTFGEAVWFKAGSQIFSEGGLDYLGNPNLVHAQSILAIWASQVVLMGLIEGYRVGGGPLGEGLDKIYPGGSFDPLGLADDPEAFAELKVKELKNGRLAMFSMFGFFVQAIVTGKGPIENLFDHLADPVANNAWAYATNFVPG

SEQ ID NO: 7628 - protein, 265 aa, Flaveria ramosissima
MATSAIQQSAFAGQPTLKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7629 - protein, 265 aa, Flaveria ramosissima
MATSAIQQSAFTSQPALKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7630 - protein, 265 aa, Flaveria ramosissima
MATSAIQQSAFAGSAALKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWACQVVLMGLIEGYRVGGGPLGEGLDKVYPGGSFDPLGLADDPDAFAELKVKELKNGRLAMFSMFGFFVQAIVTGKGPIENLFDHISDPVANNAWAYATNFVPGK

SEQ ID NO: 7631 - protein, 265 aa, Gossypium raimondii
MATSAIQQSAFVGQTALKQSNELLRKVGAFNGGRVTMRRTVKSAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 7632 - protein, 265 aa, Actinidia deliciosa
MATSAIQHAAFAGQTALNRQNEFFRKVGPIGGTRFTMRRTVKSTPQSIWYGPDRPKYLGPFSEQTPSYLTGEFPGDYGWDTAGLSADPETFAKNRELEVIHCRWAMLGALGCVFPEILSKNGVKFGEAVWFKAGSQIFSEGGLDYLGNPNLVHAQSILAIWACQVVLMGFVEGYRIGGGPLGEGLDKIYPGGAFDPLGLADDPEAFAELKVKEIKNGRLAMFSMFGFFVQAIVTGKGPIENLSDHLADPVANNAWAYATNFVPGK

SEQ ID NO: 7633 - protein, 265 aa, Nicotiana benthamiana
MATSAIQQSAFAGQTALKSQNELVRKIGSFNGGRATMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLIHAQSILAIWASQVVLMGLIEGYRVGGGPLGEGLDKIYPGGAFDPLGLADDPEAFAELKVKEIKNGRLAMFSMFGFFVQAIVTGKGPIENLYDHIADPVANNAWAFATNFVPGK

SEQ ID NO: 7634 - protein, 265 aa, Olea europaea
MATSAIQQSAFAGQTALKSQNQLIRKVGNLGGGRFTMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLIHAQSILAIWACQVVLMGFVEGYRVGGGPLGEGLDKIYPGGAFDPLGLADDPEAFAELKVKEIKNGRLAMFSMFGFFVQAIVTGKGPIENLFDHIADPVANNAWAYATNFVPGK

SEQ ID NO: 7635 - protein, 265 aa, Petunia hybrida
MATSAIQQSAFAGQTALKSQNELVRKIGSFGGGRATMRRTVKSAPQSIWYGEDRPKYLGPFSEQTPSYLTGEFPGDYGWDTAGLSADPETFARNRELEVIHCRWAMLGALGCVFPEILSKNGVTFGEAVWFKAGSQIFSEGGLDYLGNPNLIHAQSILAIWAAQVVLMGFVEGYRVGGGPLGEGLDKIYPGGAFDPLGLADDPEAFAELKVKEIKNGRLAMFSMFGFFVQAIVTGKGPIENLYDHVADPVANNAWAFATNFVPGK

SEQ ID NO: 7636 - protein, 265 aa, Unknown
  Sequence found in Organisms: Solanum tuberosum, Solanum phureja
MATSAIQQSAFVGQAVGKSQNEFVRKVGSFGEGRITMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLVHAQSILAIWACQVVLMGFVEGYRVGGGPLGEGLDKIYPGGAFDPLGLADDPEAFAELKVKEIKNGRLAMFSMFGFFVQAIVTGKGPIENLSDHINDPVANNAWAYATNFVPGK

SEQ ID NO: 7637 - protein, 265 aa, Nicotiana tabacum
MATSAIQQSAFVGQTVAKSQNELVRKIGSFGGGRATMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGAQIFSEGGLDYLGNPNLVHAQSILAIWACQVVLMGLIEGYRVGGGPLGEGLDKIYPGGAFDPLGLADDPEAFAELKVKEIKNGRLAMFSMFGFFVQAIVTGKGPIENLFDHINDPVANNAWAFATNFVPGK

SEQ ID NO: 7638 - protein, 265 aa, Tripterygium wilfordii
MATSAIQQSAFAGQTALKQPNEFVRRVGSFGGGRISMRRTVKSAPQSIWYGPDRPKYLGPFSEQTPSYLSGEFPGDYGWDTAGLSADPETFAKNRELEVIHSRWAMLGALGCVFPEILSKNGVKFGEAVWFKAGAQIFSEGGLDYLGNPNLIHAQSILAIWASQVVLMGFVEGYRIGGGPLGEGLDPLYPGGAFDPLGLADDPEAFAELKVKELKNGRLAMFSMFGFFVQAIVTGKGPIENLFDHVADPVANNAWAYATNFVPGK

SEQ ID NO: 7639 - protein, 265 aa, Juglans hindsii x Juglans regia
MATSAIQRSAFAGQTALKQSNELVRRAGGIGGGRVTMRRTVKSAPQSIWYGPDRPKYLGPFSEQTPSYLTGEFPGDYGWDTAGLSADPETFAKNRELEVIHSRWAMLGALGCVFPEVLSKNGVKFGEAVWFKAGAQIFSEGGLDYLGNPNLVHAQSILAIWAVQVVLMGFVEGYRIGGGPLGEGLDPIYPGGAFDPLGLADDPEAFAELKVKELKNGRLAMFSMFGFFVQAIVTGKGPIENLYDHVADPVANNAWAYATNFVPGK

SEQ ID NO: 7640 - protein, 265 aa, Citrullus lanatus
MATSAIQQSAFAGQAALKQSNELVRRVGAVGGGRFTMRRTVKSAPQSIWYGPDRPKYLGPFSEQTPSYLTGEFPGDYGWDTAGLSADPETFAKNRELEVIHSRWAMLGALGCVFPELLAKNGVQFGESVWFKAGSQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIENLFDHVADPVANNAWAYATNFVPGK

SEQ ID NO: 7641 - protein, 261 aa, Solanum melongena
MATSAIQQSAFVGQSQNEFVRRFGNVGGGRITMRRTVKSAPQSIWYGEDRPKYLGPFSEQTPSYLTGEFPGDYGWDTAGLSADPETFARNRELEVIHCRWAMLGALGCVFPEILAKNGVKFGEAVWFKAGSQIFSEGGLDYLGNPNLVHAQSILAIWACQVVLMGFVEGYRVGGGPLGEGLDKIYPGGAFDPLGLADDPDAFAELKVKEIKNGRLAMFSMFGFFVQAIVTGKGPIENLFDHINDPVANNAWAYATNFVPGK

SEQ ID NO: 7642 - protein, 267 aa, Quercus alba
MATSTIQRSAFAGHTHTALKQSNDFIRKVGSFGGGRVTMRRTVKSAPQSIWYGPDRPKYLGPFSEQTPSYLTGEFPGDYGWDTAGLSADPETFARNRELEVIHSRWAMLGALGCVFPEVLSKNGVKFGEAVWFKAGAQIFSEGGLDYLGNPNLIHAQSILAIWAVQVVLMGFIEGYRVGGGPLGEGLDPIYPGGAFDPLGLADDPEAFAELKVKELKNGRLAMFSMFGFFVQAIVTGKGPIENLFDHVADPVANNAWAYATNFVPGK

SEQ ID NO: 7643 - protein, 196 aa, Quercus alba
MATSTIQRSAFAGHTHTALKQSNDFIRKVGSFGGGRVTMRRTVKSAPQSIWYGPDRPKYLGPFSEQTPSYLTGEFPGDYGWDTAGLSADPETFARNRELEVIHSRWAMLGALGCVFPEVLSKNGVKFGEAVWFKAGAQIFSEGGLDYLGNPNLIHAQSILAIWAVQVVLMGFIEGYRVGGGPLGEGLDPHLPWWRL

SEQ ID NO: 7644 - protein, 265 aa, Ambrosia trifida
MATSAIQQSAFAGQAALKPQNELVRKTGSVNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLYDHLSDPVANNAWAYATNFVPGK

SEQ ID NO: 7645 - protein, 265 aa, Artemisia annua
MATSAIQQAAFAGQSAMKPQNELVRKIGGFNGGRYTMRRTVKSAPQSIWYGPDRPKYLGPFSEQTPSYLTGEFPGDYGWDTAGLSADPETFAKNRELEVIHSRWAMLGALGCVFPEVLSKNGVKFGEAVWFKAGSQIFSEGGLDYLGNPNLIHAQSILAIWASQVVLMGLIEGYRVGGGPLGEGLDSIYPGGSFDPLGLADDPEAFAELKVKELKNGRLAMFSMFGFFVQAIVTGKGPIENLFDHLADPAANNAWAYATNFVPGK

SEQ ID NO: 7646 - protein, 265 aa, Artemisia annua
MATSAIQQSAFVGESAVKPQNELVRKIGSFNGGRFTMRRTVKSAPQSIWYGPDRPKYLGPFSEQTPSYLTGEFPGDYGWDTAGLSADPETFAKNRELEVIHSRWAMLGALGCVFPELLSKNGVKFGEAVWFKAGSQIFSEGGLDYLGNPNLIHAQSILAIWASQVVLMGLIEGYRVGGGPLGEGLDSIYPGGSFDPLGLADDPEAFAELKVKELKNGRLAMFSMFGFFVQAIVTGKGPIENLFDHLSDPVANNAWAYATNFVPGK

SEQ ID NO: 7647 - protein, 266 aa, Cleome gynandra
MAATSAIQKTAFAGQTALKQPNELVRKVGVYGGGRVTMRRTVKSAPQSIWYGPDRPKYLGPFSENTPSYLTGEYPGDYGWDTAGLSADPETFAKNRELEVIHCRWAMLGALGCLFPEILSKNGVKFGEAVWFKAGSQIFSEGGLDYLGNPNLIHAQSILAIWACQVVLMGFVEGYRVGGGPLGEGLDPIYPGGAFDPLNLAEDPEAFAELKVKEIKNGRLAMFSMFGFFVQAIVTGKGPVENLFDHVADPVANNAWAYATNFVPGK

SEQ ID NO: 7648 - protein, 265 aa, Unknown
  Sequence found in Organisms: Gossypium hirsutum, Gossypium raimondii
MATSAIQQSAFVGQTALKQSNELLRKVGAFDGGRVTMRRTVKSAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLLDHLADPVANNAWAYATNFVPGK

SEQ ID NO: 7649 - protein, 265 aa, Gossypium hirsutum
MATSAIQQSAFVGQTALKQSNELLRKVGAFNGGRVTMRRTVKSAPTSIWYGPDRPKYLGPFSDQIPSYLTGEFPGNYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 7650 - protein, 265 aa, Euonymus alatus
MATSAIQQSAFAGQTALKQPNEFVRRVGSFGGGRISMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGAQIFSEGGLDYLGNPNLIHAQSILAIWASQVVLMGFVEGYRIGGGPLGEGLDPLYPGGAFDPLGLADDPEAFAELKVKELKNGRLAMFSMFGFFVQAIVTGKGPIENLSDHIADPVANNAWAYATNFVPGK

SEQ ID NO: 7651 - protein, 265 aa, Fraxinus spp
MATSAIQQSAFAGQTTLKSQNQLIRKVGNLGGGRFTMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLVHAQSILAIWACQVVLMGFVEGYRIGGGPLGEGLDKIYPGGAFDPLGLADDPEAFAELKVKEIKNGRLAMFSMFGFFVQAIVTGKGPIENLVDHVADPVANNAWAYATNFVPGK

SEQ ID NO: 7652 - protein, 265 aa, Humulus lupulus
MATSAIQQSAFAGQTALKQSNELVRKVGASSGGRATMRRTVKSAPQSIWYGPDRPKYLGPFSEQIPSYLNGEFPGDYGWDTAGLSADPETFARNRELEVIHSRWAMLGALGCVFPELLSKNGVKFGEAVWFKAGSQIFSEGGLDYLGNPNLVHAQSILAIWATQVVLMGFVEGYRVGGGPLGEGLDPVYPGGAFDPLGLADDPDAFAELKVKELKNGRLAMFSMFGFFVQAIVTGKGPIENLVDHLADPVTNNAWAYATNFVPGK

SEQ ID NO: 7653 - protein, 265 aa, Mimulus guttatus
MATSAIQQSAFSGKTALKPQNELIRKIGNVGGGRFTMRRTVKSAPQSIWYGEDRPKYLGPFSEQTPSYLTGEFPGDYGWDTAGLSADPETFAKNRELEVIHSRWAMLGALGCVFPEVLSKNGVKFGEAVWFKAGSQIFSEGGLDYLGNPNLVHAQSILAIWATQVVLMGFVEGYRVGGGPLGEGLDKVYPGGSFDPLGLAEDPEAFAELKVKELKNGRLAMFSMFGFFVQAIVTGKGPIENLFDHLADPVANNAWAFATNFVPGK

SEQ ID NO: 7654 - protein, 265 aa, Parthenium argentatum
MATSAIQQSAFAGQAALKPQNELVRKTGSVNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWASQVVLMGLIEGYRVGGGPLGEGLDKIYPGGSFDPLGLADDPEAFAELKVKELKNGRLAMFSMFGFFVQAIVTGKGPIENLFDHFSDPVANNAWAYATNFVPGK

SEQ ID NO: 7655 - protein, 265 aa, Lippia dulcis
MATSAFQQSAFAGQTALKPQNDIVRKIGNVGGSRIVMRRTVKSAPESIWYGPDRPKYLGPFSEQTPSYLTGEFPGDYGWDTAGLSADPETFAKNRELEVIHCRWAMLGALGCVFPEILARNGVKFGEAVWFKAGSQIFSEGGLDYLGNPNLIHAQSILAIWACQVVLMGFVEGYRVGGGPLGEGLDKIYPGGAFDPLGLADDPEAFAELKVKEIKNGRLAMFSMFGFFVQAIVTGKGPIENLYDHVADPVANNAWAYATNFVPGK

SEQ ID NO: 7656 - protein, 265 aa, Primula obconica
MATSAIQQSAFAGQTGLKAQNELVRKVGSFGGGRATMRRTVKSTSQSIWYGEDRPKYLGPFSEQTPSYLTGEFPGDYGWDTAGLSADPETFAKNRELEVIHSRWAMLGALGCVFPEILAKNGVKFGEAIWFKAGSQIFSEGGLDYLGNPNLVHAQSILAIWASQVVLMGFVEGYRVGGGPLGEGLDKVYPGGSFDPLGLADDPEAFAELKVKELKNGRLAMFSMFGFFVQAIVTGKGPVENLYDHLADPVANNAWAFATNFVPGK

SEQ ID NO: 7657 - protein, 265 aa, Primula obconica
MATSAIQQSAFAGQTGLKAQNELVRKVGSFGGGRATMRRTVKSTSQSIWYGEDRPKYLGPFSEQTPSYLTGEFPGDYGWDTAGLSADPETFAKNRELEVIHSRWAMLGALGCVFPELLAKNGVKFGEAVWFKAGSQIFSEGGLDYLGNPNLVHAQSILAIWACQVVLMGFVEGYRIGGGPLGEGLDKVYPGGSFDPLGLADDPEAFAELKVKELKNGRLAMFSMFGFFVQAIVTGKGPVENLYDHLADPVANNAWAFATNFVPGK

SEQ ID NO: 7658 - protein, 265 aa, Nicotiana tabacum
MATSAIQQSAFVGRTVAKSQNELVRKIGSFGGGRATMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGAQIFSEGGLDYLGNPNLVHAQSILAIWACQVVLMGLIEGYRVGGGPLGEGLDKIYPGGAFDPLGLADDPEAFAELKVKEIKNGRLAMFSMFGFFVQAIVTGKGPIENLYDHINDPVANNAWAFATNFVPGK

SEQ ID NO: 7659 - protein, 265 aa, Nicotiana benthamiana
MATSAIQESAFVGRTVAKSQNELVRKIGSFGGGRATMRRTVKSAPQSIWYGEDRPKYLGPFSEQTPSYLTGEFPGDYGWDTAGLSADPKTFAKNRELEVIHCRWAMLGALGCVFPEILSKNGVKFGEAVWFKAGAQIFSEGGLDYLGNPNLVHAQSILAIWACQVVLVGLIEGYRVGGGPLGEGLDKIYPGGAFDPLGLADDPEAFAELKVKEIKNGRLAMFSMFGFFVQAIVTGKGPIENLFDHINDPVANNAWAFATNFVPGK

SEQ ID NO: 7660 - protein, 284 aa, Ricinus communis
MATSAIQQSAFAGQTALKPSNELVRKVGSVGGGRITMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLIHAQSILAIWACQVVLMGFVEGYRVGGGPLGEGLDPIYPGGAFDPLGLADDPEAFAELKVKEIKNGRLAMFSMFGFFVQLLSLERDLLRTSSIMLLTQWPTMHGLTPLTSFPESEKDQIYAFGCNITQSLSFY

SEQ ID NO: 7661 - protein, 232 aa, Flaveria ramosissima
MATSAIQQSAFTSQPALKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFSFKPL

SEQ ID NO: 7662 - protein, 71 aa, Flaveria ramosissima
MATSAIQQSAFTSQPALKPQNELAKKTGGFNGGRFTMRRTVKSAPQSIWYGPDRPKYLGPFSEQTPSIPNW

SEQ ID NO: 7663 - protein, 83 aa, Flaveria ramosissima
MATSAIQQSAFTSQPALKPQNELVKNGGFNGGRFTMRRTVKSAPQSIWYGPDRPKYLGPFSEQTPSYLTGEFPGDYGWDTAGL

SEQ ID NO: 7664 - protein, 265 aa, Artemisia annua
MATSAIQQAAFAAQSALKPQNELVRKVGGFNGGRYTMRRTVKSAPQSIWYGPDRPKYLGPFSEQTPSYLTGEFPGDYGWDTAGLSADPETFAKNRELEVIHSRWAMLGALGCVFPEVLSKNGVKFGEAVWFKAGSQIFSEGGLDYLGNPNLIHAQSILAIWASQVVLMGLIEGYRVGGGPLGEGLDSIYPGGSFDPLGLADDPEAFAELKVKELKNGRLAMFSMFGFFVQAIVTGKGPIENLFDHLADPAANNAWAYATNFVPGK

SEQ ID NO: 7665 - protein, 264 aa, Unknown
  Sequence found in Organisms: Beta vulgaris, Triticum aestivum
MATSTIQQSAFAGQTILKPQNELVRKFGGNGGRASMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFQEGGLDYLGNPNLIHAQSILAIWASQVVLMGLIEGYRVGGGPLGEGLDKLYPGGAFDPLGLADDPEAFAELKVKELKNGRLAMFSMFGFFVQAIVTGKGPIENLSDHLADPVANNAWAFATNFVPGK

SEQ ID NO: 7666 - protein, 263 aa, Vaccinium corymbosum
MATSAIQQSAFLGSRAASKRRVKKVSGFTAGRIMMRRTVKSVPQSIWYGPDRPKYLGPFSEQTPSYLTGEFPGDYGWDTAGLSADPETFAKNRELEVIHSRWAMLGALGCVFPEILAKNGVKFGESVWFKAGAQIFSEGGLDYLGNPNLIHAQSILAIWACQVVLMGFVEGYRVGGGPLGEGLDKIYPGGAFDPLGLADDPEAFAELKVKELKNGRLAMFSMFGFFVQAIVTGKGPIENLFDHLADPVANNAWAYATNFVPGK

SEQ ID NO: 7667 - protein, 264 aa, Carpinus betulus
MATSAIQRSAFAGQTALKQSNELVRKAGSFGGRVTMRRTIKSTPQSIWYGPDRPKYLGPFSEQTPSYLTGEFPGDYGWDTAGLSADPETFARNRELEVIHSRWAMLGALGCVFPELLSKNGIKFGEAVWFKAGSQIFSEGGLDYLGNPNLIHAQSILAIWAVQVVLMGFIEGYRVGGGPLGEGLDPIYPGGAFDPLGLADDPEAFAELKVKELKNGRLAMFSMFGFFVQAIVTGKGPIENLSDHLADPVANNAWAYATNFVPGK

SEQ ID NO: 7668 - protein, 160 aa, Vaccinium corymbosum
MLGALGCVFPEILAKNGVKFGESVWFKAGAQIFSEGGLDYLGNPNLIHAQSILAIWASQVVLMGFVEGYRVGGGPLGEGLDKIYPGGAFDPLGLADDPEAFAELKVKELKNGRLAMFSMFGFFVQAIVTGKGPIENLFDHVADPVANNAWAYATNFVPGK

SEQ ID NO: 7669 - protein, 231 aa, Leymus cinereus x Leymus triticoides
ITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFAPGS

SEQ ID NO: 7670 - protein, 268 aa, Flaveria ramosissima
MATSAIQQSAFAGSAALKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWACQVVLMGLIEGYRVGGGPLGEGLDKVYPGGSFDPLGLADDPDAFAELKVKELKNGRLAMFSMFGFFVQAIVTGKGPIENLFDHVSDPVANNAWAYATNFVPGNEFE

SEQ ID NO: 7671 - protein, 240 aa, Quercus alba
MATSTIQRSAFAGHTHTALKQSNDFIRKVGGFGGGRVTMRRTVKSAPQSIWYGPDRPKYLGPFSEQTPSYLTGEFPGDYGWDTAGLSADPETFARNRELEVIHSRWAMLGALGCVFPEILSKNGVKFGEAVWFKAGAQIFSEGGLDYLGNPNLIHAQSILAIWAVQVVLMGFIEGYRVGGGPLGEGLDPIYPGGAFDPLGLADDPEAFAELKVKELKMGVGNVLHVWFLCSGYCYWKGSN

SEQ ID NO: 7672 - protein, 94 aa, Malus domestica
MSRGLQIVQQCPIRSHRGIHRSSMMEFARRTVPSTSAGLGRAYHMLWGALLTVRRMEKRPPPRPPIFRTSSFDCFKTVWPANADRWIAEVAMAC

SEQ ID NO: 7673 - protein, 265 aa, Amsonia hubrichtii
MATSGIQQSAFAGQTVLKLQNELIRKVGSLGAGRFTMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLIHAQSILAIWAVQVVLMGLIEGYRVGGGPLGEGLDKIYPGGAFDPLGLADDPEAFAELKVKEIKNGRLAMFSMFGFFVQAIVTGKGPIENLFDHVADPVANNAWAYATNFVPGK

SEQ ID NO: 7674 - protein, 263 aa, Cirsium arvense
TSAIQHSAFAGQPALKPQNDLIRKTGTFNGGRYTMRRTVKSAPQSIWYGPDRPKYLGPFSEQTPSYLTGEFPGDYGWDTAGLSADPETFAKNRELEVIHSRWAMLGALGCVFPELLSKNGVKFGEAVWFKAGSQIFSEGGLDYLGNPNLVHAQSILAIWASQVVLMGLIEGYRVGGGPLGEGLDKIYPGGAFDPLGLADDPEAFAELKVKELKNGRLAMFSMFGFFVQAIVTGKGPIENLSDHLSDPVANNAWAYATNFVPGK

SEQ ID NO: 7675 - protein, 265 aa, Coffea canephora
MATSGIQQSAFAGQTALKPQNELLRKVGSFGGGRFSMRRTVKSAPQSIWYGPDRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLIHAQSILAIWASQVVLMGLIEGYRVGGGPLGEGLDKIYPGGAFDPLGLADDPDAFAELKVKEIKNGRLAMFSMFGFFVQAIVTGKGPIQNLIDHLADPVTNNAWAYATNFVPGK

SEQ ID NO: 7676 - protein, 265 aa, Euonymus alatus
MTTSAIQQSAFAGQTALKQPNEFVRRVGSFGGGRISMRRTVKSAPQSIWYGPDRPKYLGPFSEQTPSYLKGEFPGDYGWDTAGLSADPETFAKNRELEVIHSRWAMLGALGCVFPEILSKNGVKFGEAVWFKAGSQIFSEGGLDYLGNPNLIHAQSILAIWASQVVLMGFVEGYRIGGGPLGEGLDPLYPGGAFDPLGLADDPEAFAELKVKELKNGRLAMFSMFGFFVQAIVTGKGPIENLYDHIADPVANNAWAYATNFVPGK

SEQ ID NO: 7677 - protein, 265 aa, Euonymus alatus
MATSAIQQSAFAGQTALKQPNEFVRRVGSFGGGRISMRRTVKSAPQSIWYGPDRPKYLGPFSEQTPSYLKGEFPGDYGWDTAGLSADPETFAKNRELEVIHSRWAMLGALGCVFPEILSKNGVKFGEAVWFKAGAQIFSEGGLDYLGNPNLIHAQSILAIWASQVVLMGFVEGYRIGGGPLGEGLDPLYPGGAFDPLGLADDPEAFAELKVKELKNGRLAMFSMFGFFVQAIVTGKGPIENLSDHIADPVANNAWAYATNFVPGK

SEQ ID NO: 7678 - protein, 265 aa, Euonymus alatus
MATSAIQQSAFAGQTALKQPNEFIRRVGSFEGGRISMRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGAQIFSEGGLDYLGNPNLIHAQSILAIWASQVVLMGFVEGYRIGGGPLGEGLDPLYPGGAFDPLGLADDPEAFAELKVKELKNGRLAMFSMFGFFVQAIVTGKGPIENLSDHIADPVANNAWAYATNFVPGK

SEQ ID NO: 7679 - protein, 265 aa, Panax ginseng
MATSAIQQSAFAGQTALKPQNELVRKIGSLGGGRITMRRTVRSAPDSIWYGPDRPKYLGPFSEQTPSYLTGEFPGDYGWDTAGLSADPETFAKNRELEVIHSRWAMLGALGCVFPEILARNGVKFGEAVWFKAGAQIFSEGGLDYLGNPNLVHAQSILAIWASQVVLMGFVEGYRVGGGPLGEGLDKIYPGGSFDPLGLADDPEAFAELKVKELKNGRLAMFSMFGFFVQAIVTGKGPIENLYDHLADPVANNAWAYATNFVPGK

SEQ ID NO: 7680 - protein, 265 aa, Ipomoea batatas
MASCGIQQSAFAGQAALKSQTDLLRKVGSSGSGRFSMRRTVKSAPQSIWYGPDRPKYLGPFSEQTPSYLTGEFPGDYGWDTAGLSADPETFARNRELEVIHSRWAMLGALGCVFPEILSKNGVKFGEAVWFKAGAQIFSEGGLDYLGNPNLIHAQSILAIWACQVVLMGFVEGYRVGGGPLGEGLDKVYPGGASDPLGLADDPEAFAELKVKELKNGRLAMFSMFGFFVQAIVTGKGPIENLFDHVADPVANNAWAYATNFVPGK

SEQ ID NO: 7681 - protein, 265 aa, Nicotiana benthamiana
MATSAIQQSAFVGRTVAKSQNELVRKIGSFGGGRATMRRTVKSAPQSIWYGEDRPKYLGPFSEQTPSYLTGEFPGDYGWDTAGLSADPETFARNRELEVIHCRWAMLGALGCVFPEILSKNGVQFGEAVWFKAGAQIFSEGGLDYLGNPNLVHAQSILAIWACQVVLMGLIEGYRVGGGPLGEGLDKIYPGGAFDPLGLADDPEAFAELKVKEIKNGRLAMFSMFGFFVQAIVTGKGPIENLYDHINDPVANNAWAFATNFVPGK

SEQ ID NO: 7682 - protein, 265 aa, Nicotiana benthamiana
  misc_feature (38)..(38): Xaa can be any naturally occurring amino acid
MATSAIQESAFVGRTVAKSQNELVRKIGSFGGGRATMXRTVKSAPQSIWYGEDRPKYLGPFSEQTPSYLTGEFPGDYGWDTAGLSADPKTFAKNRELEVIHCRWAMLGALGCVFPEILSKNGVKFGEAVWFKAGAQIFSEGGLDYLGNPNLVHAQSILAIWACQVVLVGLIEGYRVGGGPLGEGLDKIYPGGAFDPLGLADDPEAFAELKVKEIKNGRLAMFSMFGFFVQAIVTGKGPIENLFDHINDPVANNAWAFATNFVPGK

SEQ ID NO: 7683 - protein, 265 aa, Capsicum annuum
MATSAIQQSAFVGQAVGKSQNELVKKIGSFNGGRFTMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLIHAQSILAIWACQVVLMGFVEGYRVGGGPLGEGLDKIYPGGAFDPLGLADDPEAFAELKVKEIKNGRLAMFSMFGFFVQAIVTGKGPIENLFDHINDPVANNAWAYATNFVPGK

SEQ ID NO: 7684 - protein, 265 aa, Pteridium aquilinum
MATSAIQQSAFAGQTALKQSNELVRKVGVFGGGRVTMRRTVKSAPASIWYGPDRPKYLGPFSDQIPSYLTGEFPGDYGWDTAGLSADPETFAKNRELEVIHCRWAMLGALGCVFPEILSRNGVKFGEAVWFKAGSQIFSEGGLDYLGNPNLIHAQSILAIWACQVVLMGFVEGYRVGGGPLGEGLDPIYPGGTFDPLGLADDPDAFAELKVKEIKNGRLAMFSMFGFFVQAIVTGKGPIENLFDHLADPATNNAWAYATNFVPGK

SEQ ID NO: 7685 - protein, 265 aa, Euphorbia esula
MATSGIQQSAFAGQIALKPSNDLLRKVGNLGGARVVMRRTVKSAPESIWYGPDRPKYLGPFSEQTPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPLYPGGAFDPLGLADDPEAFAELKVKEIKNGRLAMFSMFGFFVQAIVTGKGPVENLYDHVADPVANNAWAFATNFVPGK

SEQ ID NO: 7686 - protein, 265 aa, Fragaria vesca
MATSAIQQSAFAGQTALKPSNELVRKIGSLGGGRISMRRTVKSAPESIWYGPDRPKYLGPFSEQTPSYLTGEFPGDYGWDTAGLSADPETFAKNRELEVIHCRWAMLGALGCVFPEVLSKNGVKFGEAVWFKAGSQIFSEGGLDYLGNPNLVHAQSILAIWAVQVVLMGFIEGYRVGGGPLGEGLDPLYPGGAFDPLGLADDPEAFAELKVKEIKNGRLAMTSMFGFFVQAIVTGKGPIENLYDHVADPVANNAWAYATNFVPGK

SEQ ID NO: 7687 - protein, 265 aa, Solanum lycopersicum
MATCAIQQSAFVGQAVGKSQNEFIRKVGNFGEGRITMRRTVKSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLVHAQSILAIWACQVVLMGFVEGYRVGGGPLGEGLDKIYPGGAFDPLGLADDPEAFAELKVKEIKNGRLAMFSMFGFFVQAIVTGKGPIENLSDHINDPVANNAWAYATNFVPGK

SEQ ID NO: 7688 - protein, 232 aa, Flaveria ramosissima
MATSAIQQSAFTSQPALKPQNELAKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFSFKPL

SEQ ID NO: 7689 - protein, 232 aa, Flaveria ramosissima
MATSAIQQSAFAGQPALKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFSFKPL

SEQ ID NO: 7690 - protein, 119 aa, Primula obconica
MATSAIQQSAFAGQTGLKAQNELVRKVGSFGGGRATMRRTVKSTSQSIWYGEDRPKYLGPFSEQTPSYLTGEFPGDYGWDTAGLSADPETFAKNRELEVIHSRWAMLGGIGLCLSRDSR

SEQ ID NO: 7691 - protein, 265 aa, Nicotiana benthamiana
MATSAIQQSAIAGQTALKSQNELIRKIGSFNGGRATMRRTVRSAPQSIWYGEDRPKYLGPFSEQTPSYLTGEFPGDYGWDTAGLSADPETFARNRELEVIHCRWAMLGALGCVFPEILSKNGVKFGEAVWFKAGSQIFSEGGLDYLGNPNLIHAQSILAIWASQVVLMGLIEGYRVGGGPLGEGLDKIYPGGAFDPLGLADDPEAFAELKVKEIKNGRLAMFSMFGFFVQAIVTGKGPIENLFDHIADPVANNAWAFATNFVPGK

SEQ ID NO: 7692 - protein, 118 aa, Flaveria ramosissima
MATSAIQQSAFTSQPALKPQNELVKKTGGFNGGRFTMRRTVKSAPQSIWYGPDRPKYLGPFSEQTPSYLTGEFPGDYGWDTAGLSADPETFAKNRELEVIHSRWAMLGARRVRVPRDS

SEQ ID NO: 7693 - protein, 68 aa, Gossypium raimondii
MATSAIQQSAFAGQTALKQSNELVCKVGAVGGGRVSMRRTVKSAPTSIGMALTAQSTWVHSLTKSHHT

SEQ ID NO: 7694 - protein, 264 aa, Amborella trichopoda
MAASAIQSSSFAGQTVLKPQSELAKKVGAYGGRIFMRRTVKSVPQSIWYGPDRPKYLGPFSEQTPSYLTGEFPGDYGWDTAGLSADPETFAKNRELEVIHCRWAMLGALGCVFPELLARNGVKFGESVWFKAGSQIFSEGGLDYLGNPNLIHAQSILAIWACQVVLMGFVEGYRVGGGPLGEGLDAIYPGGAFDPLGLADDPEAFAELKVKEIKNGRLAMFSMFGFFVQAIVTGKGPIENLFDHLADPVANNAWAYATNFVPGK

SEQ ID NO: 7695 - protein, 265 aa, Arnica chamissonis
MATSAIQQSAFAGQAALKPQNELVRKTGSFNGGRFTMRRTVKSAPQSIWYGPDRPKYLGPFSEQTPSYLTGEFPGDYGWDTAGLSADPETFAKNRELEVIHSRWAMLGALGCVFPELLAKNGVKFGEAVWFKAGSQIFSEGGLDYLGNPNLIHAQSILAIWASQVVLMGLIEGYRVGGGPLGEGLDAIYPGGSFDPLGLADDPEAFAELKVKELKNGRLAMFSMFGFFVQAIVTGKGPIENLSDHLSDPVANNAWAYATNFVPGK

SEQ ID NO: 7696 - protein, 265 aa, Arnica chamissonis
MATSAIQQSAFAGQPALKPQNELVRKTGGFNGGRFTMRRTVKSAPQSIWYGPDRPKYLGPFSEQTPSYLTGEFPGDYGWDTAGLSADPETFAKNRELEVIHSRWAMLGALGCVFPELLAKNGVKFGEAVWFKAGSQIFSEGGLDYLGNPNLIHAQSILAIWASQVVLMGLIEGYRVGGGPLGEGLDQIYPGGSFDPLGLADDPEAFAELKVKELKNGRLAMFSMFGFFVQAIVTGKGPIENLFDHLSDPVANNAWAYATNFVPGK

SEQ ID NO: 7697 - protein, 265 aa, Artemisia annua
MATSAIQQSAFVGESALKPQNELVRKTGSFNGGRFTMRRTVKSAPQSIWYGPDRPKYLGPFSEQTPSYLTGEFPGDYGWDTAGLSADPETFAKNRELEVIHSRWAMLGALGCVFPELLSKNGVKFGEAVWFKAGSQIFSEGGLDYLGNPNLIHAQSILAIWASQVVLMGLIEGYRIGGGPLGEGLDSIYPGGSFDPLGLADDPEAFAELKVKELKNGRLAMFSMFGFFVQAIVTGKGPIENLSDHLSDPVANNAWAYATNFVPGK

SEQ ID NO: 7698 - protein, 265 aa, Brassica juncea
MATSAIQQSSFAGQTALKPSNDLLRKVGVSNGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFAELKVKELKNGRLAMFSMFGFFVQAIVTGKGPIENLFDHLADPVANNAWSYATNFVPGK

SEQ ID NO: 7699 - protein, 265 aa, Unknown
  Sequence found in Organisms: Brassica napus, Brassica oleracea
MATSAIQQSSFAGQTALKPSNDLLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFAELKVKELKNGRLAMFSMFGFFVQAIVTGKGPIENLFDHLADPVANNAWSYATNFVPGK

SEQ ID NO: 7700 - protein, 265 aa, Fagus grandifolia
MATSTIQQSAFAGQTALKQSNELIRKAGGFGGGRVTMRRTIKSVPQSIWYGPDRPKYLGPFSEQTPTYLTGEFPGDYGWDTAGLSADPETFAKNRELEVIHSRWAMLGALGCVFPEVLSKNGVKFGEAVWFKAGAQIFSEGGLDYLGNPNLIHAQSILAIWACQVVLMGFIEGYRVGGGPLGEGLDPIYPGGAFDPLGLADDPEAFAELKVKELKNGRLAMFSMFGFFVQAIVTGKGPIENLSDHIADPVANNAWAYATNFVPGK

SEQ ID NO: 7701 - protein, 265 aa, Unknown
  Sequence found in Organisms: Gossypium hirsutum, Gossypium raimondii
MATSAIQQSAFAGQTALKQSNELVCKIGAVGGGRVSMRRTVKSAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 7702 - protein, 265 aa, Eucalyptus grandis
MATTVIQQSAFAGQTALKQSSELVRKVGNFAGGRATMRRTVKSVPQSIWYGPDRPKYLGPFSEQTPSYLTGEFPGDYGWDTAGLSADPETFAKNRELEVIHCRWAMLGALGCVFPEILQKNGVKFGEAVWFKAGAQIFSEGGLDYLGNPNLIHAQSILAIWACQVVLMGLIEGYRVGGGPLGEGLDPLYPGGAFDPLGLADDPDAFAELKVKEIKNGRLAMFSMFGFFVQAIVTGKGPIENLFDHLADPAANNAWAYATNFVPGK

SEQ ID NO: 7703 - protein, 265 aa, Ipomoea nil
MASCGIQQSAFAGQSALKSQTDLLRKVGSSGSARFTMRRTVKSAPQSIWYGPDRPKYLGPFSEQTPSYLTGEFPGDYGWDTAGLSADPETFARNRELEVIHSRWAMLGALGCVFPEILSKNGVKFGEAVWFKAGAQIFSEGGLDYLGNPNLIHAQSILAIWASQVVLMGFVEGYRVGGGPLGEGLDKVYPGGAFDPLGLADDPEAFAELKVKELKNGRLAMFSMFGFFVQAIVTGKGPIENLFDHVADPVANNAWAYATNFVPGK

SEQ ID NO: 7704 - protein, 265 aa, Lotus japonicus
MATSAIQQSAFTGQTALKQGNELLRKAGGFGKGRFTMRRTVKSAPQSIWYGPDRPKYLGPFSEQIPSYLTGEFPGDYGWDTAGLSADPETFAKNRELEVIHSRWAMLGALGCTFPEILERNGVKFGEAVWFKAGAQIFSEGGLDYLGNPNLIHAQSILAIWATQVVLMGLIEGYRVGGGPLGEGLDPLYPGGAFDPLGLADDPDAFAELKVKELKNGRLAMFSMFGFFVQAIVTGKGPIQNLYDHVADPVANNAWAFATNFVPGQ

SEQ ID NO: 7705 - protein, 266 aa, Tropaeolum majus
MAATSAIQQSAFSGQTALKQSNELLTKVGALGEGRITMRRTVRSTPQSIWYGADRPKYLGPFSEQTPSYLTGEFPGDYGWDTAGLSADPETFAKNRELEVIHSRWAMLGALGCVFPEILSKNGVTFGEAVWFKAGSQIFSEGGLDYLGNPNLVHAQSILAIWATQVVLMGFVEGYRVGGGPLGEGLDPLYPGGAFDPLGLADDPEAFAELKVKELKNGRLAMFSMFGFFVQAIVTGKGPIENLSDHIADPVANNAWAFATNFVPGK

SEQ ID NO: 7706 - protein, 265 aa, Plantago ovata
MATSAIQNSAFAGQTVLKPQSEFMRKVGYLGEGRMTMRRTVKSAPQSIWYGPDRPKYLGPFSEQTPSYLTGEFPGDYGWDTAGLSADPETFAKNRELEVIHSRWAMLGALGCIFPEILSKNGVKFGEAVWFKAGSQIFSEGGLDYLGNPNLIHAQSILAILGSQVVLMGLIEGYRIGGGPLGEGLDKLYPGGAFDPLGLAEDPDAFAELKVKELKNGRLAMFSMFGFFVQAIVTGKGPIENLFDHVADPVANNAWAYATNFVPGK

SEQ ID NO: 7707 - protein, 264 aa, Platanus occidentalis
MATSAIQGSAFTGQTVLKQQNELVRKVGVSGGRISMRRTVKSVAQSMWYGPDRPKYLGPFSEQTPSYLTGEFPGDYGWDTAGLSADPETFAKNRELEVIHCRWAMLGALGCVFPEILAKNGVKFGEAVWFKAGSQIFSEGGLDYLGNPNLIHAQSILAIWACQVVLMGFVEGYRVGGGPLGEGLDAIYPGGAFDPLGLADDPEAFAELKVKEIKNGRLAMFSMFGFFVQAIVTGKGPIENLYDHVADPVANNAWAYATNFVPGK

SEQ ID NO: 7708 - protein, 265 aa, Raphanus sativus
MATSAIQQSSFAGQTALKPSNDLLRKVGVSDGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGLIEGYRIGGGPLGEGLDPLYPGGAFDPLNLAEDPEAFAELKVKELKNGRLAMFSMFGFFVQAIVTGKGPIENLFDHLADPVANNAWSFATNFVPGK

SEQ ID NO: 7709 - protein, 265 aa, Rosa hybrid cultivar
MATSAIQQSAFAGQTALKPSNELVRKIGGLGGGRISMRRTVKSAPESIWYGPDRPKYLGPFSEQTPSYLTGEFPGDYGWDTAGLSADPETFAKNRELEVIHCRWAMLGALGCVFPEVLSKNGVKFGEAVWFKAGSQIFSEGGLDYLGNPNLVHAQSILAIWAVQVVLMGFIEGYRIGGGPLGEGLDPLYPGGAFDPLGLADDPEAFAELKVKEIKNGRLAMTSMFGFFVQAIVTGKGPIENLYDHVADPVANNAWAYATNFVPGK

SEQ ID NO: 7710 - protein, 265 aa, Glycine max
MATSAIQQSAFAGQTALKQLNELVRKTGGAGKGRTNMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGSQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLYDHVADPVANNAWAYATNFVPGQ

SEQ ID NO: 7711 - protein, 265 aa, Tragopogon dubius
MATSAIQQSAFAGQVALKPQNELTRKTATFNGGRYTMRRTVKSAPQSIWYGPDRPKYLGPFSEQTPSYLTGEFPGDYGWDTAGLSADPETFAKNRELEVIHSRWAMLGALGCIFPELLSKNGVKFGEAVWFKAGSQIFSEGGLDYLGNPNLIHAQSILAIWASQVVLMGLIEGYRVGGGPLGEGLDSIYPGGAFDPLGLADDPEAFAELKVKELKNGRLAMFSMFGFFVQAIVTGKGPIENLFDHLNDPVANNAWAYATNFVPGK

SEQ ID NO: 7712 - protein, 277 aa, Zamia vazquezii
MACVTSASAIQSATLAGQTALKPRDELARRVGTSEGRITMRRTVKSAPQSIWYGPDRPKYLGPFSEQTPSYLTGEFPGDYGWDTAGLSADPETFARNRELEVIHARWAMLGALGCVFPEILARNGVKFGEAVWFKAGAQIFSEGGLDYLGNPNLVHAQSILAIWAVQVVLMGFVEGYRGRGRTPRGGAGSALPGRRLRPAGVGRRPRHLRGAEGEGAQERAVGHVLHVRLLRAGHRHRQGPHRESLRSPRRPHRQQRLGLRHQLRPRQVTQISPNNE

SEQ ID NO: 7713 - protein, 240 aa, Panicum virgatum
GAGADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 7714 - protein, 229 aa, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDHRRRAQGEGAQERPPRHVLHVRLLRAG

SEQ ID NO: 7715 - protein, 263 aa, Triphysaria pusilla
MATSSAFAGQTALKPQNELIRKVGNLGATGGRFTMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGSQIFSEGGLDYLGNPNLIHAQSILAIWATQVVLMGFIEGYRVGGGPLGEGLDKLYPGGSFDPLGLADDPEAFAELKVKELKNGRLAMFSMFGFFVQAIVTGKGPVENLYDHLADPVANNAWAFATNFAPGK

SEQ ID NO: 7716 - protein, 287 aa, Triticum aestivum
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVTTTRGPSPPTSPPEAKCVKPSVRPSDEICMCTCTSWINV

SEQ ID NO: 7717 - protein, 150 aa, Flaveria ramosissima
MATSAIQQSAFAGSAALKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAVLRIVSEGGLTISGTQT

SEQ ID NO: 7718 - protein, 265 aa, Unknown
  Sequence found in Organisms: Brassica juncea, Brassica rapa
MATSAIQQSSFAGQTALKPSNDLLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGLIEGYRIGGGPLGEGLDPLYPGGAFDPLNLAEDPEAFAELKVKELKNGRLAMFSMFGFFVQAIVTGKGPIENLFDHLADPVANNAWSYATNFVPGK

SEQ ID NO: 7719 - protein, 264 aa, Brassica juncea
MATSAIQQSSFAGQTALKTSNELLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFAELKVKELKNGRLAMFSMFGFFVQAIVTGKGPIENLFDHLADPVANNAWSYATNFVPG

SEQ ID NO: 7720 - protein, 264 aa, Musa acuminata
MATSALQQSAFAGQTALKQQNELVRRVGSSRGRFFMRRTTASTPKSIWYGPDRPKYLGPFSEQTPSYLTGEFPGDYGWDTAGLSADPETFAKNRELEVIHGRWAMLGALGCVFPEILAKNGVKFGEAVWFKAGAQIFSEGGLDYLGNPNLIHAQSILAIWACQVVLMGFVEGYRVGGGPLGEGLDAIYPGGAFDPLGLADDPDAFAELKVKEIKNGRLAMFSMFGFFVQAIVTGKGPIENLYDHLADPVANNAWAYATNFVPGK

SEQ ID NO: 7721 - protein, 261 aa, Flaveria ramosissima
AIQQSAFAGQPALKPQNELVKKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWATQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7722 - protein, 265 aa, Elaeis guineensis
MASASAFQRSAFAGQTALKRQNELVQKVGVFEGRISMRRTVKSAPQSMWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLIHAQSILAIWACQVVLMGFVEGYRVGGGPLGQGLDAIYPGGAFDPLGLADDPEAFAELKVKEIKNGRLAMFSMFGFFVQAIVTGKGPIENLFDHLADPAANNAWAYATNFVPGK

SEQ ID NO: 7723 - protein, 265 aa, Allium cepa
MAASAIQRSAFAGQTALKSSNELARKVGSAGNGRFTMRRTVKSAPQSIWYGPDRPKYLGPFSEQTPSYLTGEFPGDYGWDTAGLSADPETFAKNRELEVIHCRWAMLGALGCVFPEVLSKNGVKFGEAVWFKAGSQIFSEGGLDYLGNPNLVHAQSILAIWAVQVVLMGFIEGYRVGGGPLGEGLDSLYPGGTFDPLGLADDPEAFAELKVKEIKNGRLAMTSMFGFFVQAIVTGKGPVENLLDHLDNPAANNAWAYATNFVPGK

SEQ ID NO: 7724 - protein, 265 aa, Solanum tuberosum
MATSAIQQSAFAGQTALKSQNEFIRKIGSFEGGRVTMRRTVKSAPQSIWYGEDRPKYLGPFSEQTPSYLTGEFPGDYGWDTAGLSADPETFARNRELEVIHCRWAMLGALGCVFPEILSKNGVTFGEAVWFKAGSQIFSEGGLDYLGNPNLIHAQSILAIWASQVVLMGFVEGYRVGGGPLGEGLDKIYPGGAFDPLGLADDPEAFAELKVKEIKNGRLAMFSMFGFFVQAIVTGKGPIENLSDHIADPVANNAWAYATNFVPGK

SEQ ID NO: 7725 - protein, 265 aa, Sarracenia psittacina
MATSAIQRSALIGQTALKPQNELIRKVGSFGGGRVTMRRTVKSVPQSIWYGPDRPKYLGPFSEQTPSYLTGEFPGDYGWDTAGLSADPETFAKNRELEVIHSRWAMLGALGIVFPEILAKNGVKFGEAVWFKAGAQIFSEGGLDYLGNPNLIHAQSILAIWASQVVLMGFVEGYRVAGGPLGEGLDKIYPGGAFDPLGLADDPEAFAELKVKELKNGRLAMFSVFGFFVQAIVTGKGPIENLTDHLADPVANNAWAYATNFVPGK

SEQ ID NO: 7726 - protein, 265 aa, Solanum phureja
MATSAIQQSAFAGQTALKSQNEFIRTIGSFEGGRVTMRRTVKSAPQSIWYGEDRPKYLGPFSEQTPSYLTGEFPGDYGWDTAGLSADPETFARNRELEVIHCRWAMLGALGCVFPEILSKNGVTFGEAVWFKAGSQIFSEGGLDYLGNPNLIHAQSILAIWASQVVLMGFVEGYRVGGGPLGEGLDKIYPGGAFDPLGLADDPEAFAELKVKEIKNGRLAMFSMFGFFVQAIVTGKGPIENLSDHIADPVANNAWAYATNFVPGK

SEQ ID NO: 7727 - protein, 265 aa, Solanum lycopersicum
MATSAIQHSAFAGQTALKSQNEFIRKIGSFEGGRVTMRRTVKSAPQSIWYGEDRPKYLGPFSEQTPSYLTGEFPGDYGWDTAGLSADPETFARNRELEVIHCRWAMLGALGCVFPEILSKNGVTFGEAVWFKAGSQIFSEGGLDYLGNPNLIHAQSILAIWASQVVLMGFVEGYRVGGGPLGEGLDKIYPGGAFDPLGLADDPEAFAELKVKEIKNGRLAMFSMFGFFVQAIVTGKGPIENLSDHIADPVANNAWAYATNFVPGK

SEQ ID NO: 7728 - protein, 251 aa, Flaveria ramosissima
AALKPQNELVRKTGGFNGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKGPIENLYDHVSDPVANNAWAYATNFVPGK

SEQ ID NO: 7729 - protein, 262 aa, Brassica juncea
MATSAIQQSSFAGQTALKTSNDLLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFAELKVKELKNGRLAMFSMFGFFVQAIVTGKGPIENLFDHLADPVANNAWSYATNFV

SEQ ID NO: 7730 - protein, 265 aa, Unknown
  Sequence found in Organisms: Brassica juncea, Brassica rapa
MATSAIQHSSFAGQTALKPSNDLLRKVGASNGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7731 - protein, 264 aa, Brassica napus
ATSAIQQSSFAGQTALKPSNDLLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGLIEGYRIGGGPLGEGLDPLYPGGAFDPLNLAEDPEAFAELKVKELKNGRLAMFSMFGFFVQAIVTGKGPIENLFDHLADPVANNAWSYATNFVPGK

SEQ ID NO: 7732 - protein, 266 aa, Cleome spinosa
MAATSAIQKTAFAGQTALNQSNEFLRKVGVSSGGRVTMRRTVKSAPQSIWYGPDRPKYLGPFSENTPSYLTGEYPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPLYPGGAFDPLNLAEDPEAFAELKVKEIKNGRLAMFSMFGFFVQAIVTGKGPIENLYDHVADPVANNAWAYATNFVPGK

SEQ ID NO: 7733 - protein, 265 aa, Curcuma longa
MATSAVHHSAFAGQTVLRQQSELARKAGAANKGRFYMRRTVATAPKSIWYGPDRPKYLGPFSEQTPKYLTGEFPGDYGWDTAGLSADPETFAKNRELEVIHSRWAMLGALGCVFPEILSKNGVKFGEAVWFKAGSQIFSEGGLDYLGNPNLVHAQSILAIWASQVVLMGLAEGYRVGGGPLGEGLDPIYPGGAFDPLGLADDPDAFSELKVKELKNGRLAMFSMFGFFVQAIVTGKGPIENLLDHIADPVNNNAWAYATNFVPGK

SEQ ID NO: 7734 - protein, 265 aa, Euphorbia peplus
MATSGIQQSAFAGQIALKPSNDLLRKVGNLGGARVVMRRTVKSAPESIWYGPDRPKYLGPFSEQTPSYLTGEFPGDYGWDTAGLSADPETFAKNRELEVIHCRWAMLGALGCVFPELLSKNGVTFGEAVWFKAGSQIFSEGGLDYLGNPNLIHAQSILAIWACQVVLMGFVEGYRIGGGPLGEGLDPLYPGGAFDPLGLADDPEAFAELKVKEIKNGRLAMFSMFGFFVQAIVTGKGPVENLYDHVADPVANNAWAFATNFVPGK

SEQ ID NO: 7735 - protein, 266 aa, Linum usitatissimum
MAATSGFQQSAFAGQTTLNRSNERTRKVAALGGSRFNMRRTVKSAPQSIWYGADRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWACQVVLMGFVEGYRVGGGPLGEGLDPLYPGGSFDPLGLADDPEAFAELKVKEIKNGRLAMFSMFGFFVQAIVTGKGPVENLYDHIADPVANNAWAFATNFVPGK

SEQ ID NO: 7736 - protein, 265 aa, Zingiber officinale
MATSAVQHSAFAGQTVLRQQSELARKAGAANKGRFYMRRTVASAPKSIWYGPDRPKYLGPFSEQTPSYLTGEFPGDYGWDTAGLSADPETFAKNRELEVIHCRWAMMGALGCVFPEILSKNGVKFGEAVWFKAGSQIFSEGGLDYLGNPNLVHAQSILAIWASQVVLMGLAEGYRVGGGPLGEGLDPIYPGGAFDPLGLADDPDAFAELKVKEVKNGRLAMFSMFGFFVQAIVTGKGPIENLLDHIADPVNNNAWAYATNFVPGK

SEQ ID NO: 7737 - protein, 261 aa, Capsicum annuum
AIQHSAFTGQTALKSQNEFVRKIGSFGGGRITMRRTVKSAPQSIWYGEDRPKYLGPFSEQTPSYLTGEFPGDYGWDTAGLSADPETFARNRELEVIHCRWAMLGALGCVFPEILSKNGVTFGEAVWFKAGSQIFSEGGLDYLGNPNLIHAQSILAIWAAQVVLMGLVEGYRVGGGPFGEGLDKIYPGGAFDPLGLADDPEAFAELKVKEIKNGRLAMFSMFGFFVQAIVTGKGPIENLFDHVADPVANNAWAYATNFVPGK

SEQ ID NO: 7738 - protein, 266 aa, Phalaenopsis aphrodite
MAISAIQGSAFTGQTALKQPNELFRKVGSVGNGGRITMRRTVKSVPQSIWYGPDRPKYLGPFSEQTPSYLTGEFPGDYGWDTAGLSADPETFAKNRELEVIHSRWAMLGALGCVFPELLSRNGVKFGEAVWFKAGAQIFSEGGLDYLGNPNLIHAQSILAIWASQVILMGFVEAYRVGGGPLGEGLDKIYPGGAFDPLGLADDPEAFAELKVKELKNGRLAMFSMFGFFVQAIVTGKGPIENLYDHLADPTTNNAWAYATNFVPGK

SEQ ID NO: 7739 - protein, 266 aa, Phalaenopsis aphrodite
MAISAIQGSAFAGQTALKQPNELFRKVGSVGNGGRITMRRTVKSVPQSIWYGPDRPKYLGPFSEQTPSYLTGEFPGDYGWDTAGLSADPETFAKNRELEVIHSRWAMLGALGCVFPELLSRNGVKFGEAVWFKAGAQIFSEGGLDYLGNPNLIHAQSILAIWASQVILMGFVEAYRVGGGPLGEGLDKIYPGGAFDPLGLADDPEAFAELKVKELKNGRLAMFSMFGFFVQAIVTGKGPIENLYDHLADPTTNNAWAYATNFVPGK

SEQ ID NO: 7740 - protein, 265 aa, Cajanus cajan
MATSAIQQSAFAGQTALKQVNEFVRKTGGSGKGRTNMRRTVKSAPQSIWYGPDRPKYLGPFSDQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLFDHVADPVANNAWAYATNFVPGQ

SEQ ID NO: 7741 - protein, 257 aa, Silene vulgaris
AIQQSAFAGQTALKQSNELVRKVGYVGGGRFTMRRTVKSTPQSIWYGPDRPKYLGPFSEQTPSYLTGEFPGDYGWDTAGLSADPETFAKNRELEVIHSRWAMLGALGCVFPEILSKNGVKFGEAVWFKAGAQIFSEGGLDYLGNPNLIHAQSILAIWASQVVLMGFVEGYRIGGGPLGEGLDPLYPGGAFDPLGLADDPDQFAELKVKELKNGRLAMFSMFGFFVQAIVTGKGPIENLVDHVADPVANNAWAYATNF

SEQ ID NO: 7742 - protein, 265 aa, Glycine max
MATSAIQQSAFTGQTALKQLNEFVRKTGGAGKGRTNMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLYDHVADPVANNAWAYATNFVPGQ

SEQ ID NO: 7743 - protein, 266 aa, Eutrema parvulum
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCIFPEILSKNGVKFGEAVWFKAGSQIFSEGGLDYLGNPNLIHAQSILAIWAAQVVLMGLIEGYRIGGGPLGEGLDPLYPGGAFDPLNLAEDPEAFSELKVKELKNGRLAMFSMFGFFVQAIVTGKGPIENLFDHVADPVANNAWAFATNFVPGK

SEQ ID NO: 7744 - protein, 265 aa, Vinca minor
MAASGIQQSAFAGQTLLKSQNELIRKVGNVGGGRFTMRRTVKSAPQSIWYGADRPKYLGPFSEQTPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWASQVVLMGLIEGYRVGGGPLGEGLDKIYPGGSFDPLGLADDPEAFAELKVKEIKNGRLAMFSMFGYFVQAIVTGKGPIENLYDHLADPVANNAWAYATNFVPGK

SEQ ID NO: 7745 - protein, 207 aa, Flaveria ramosissima
MATSAIQQSAFTSQPALKPQNELVKKTGGFNGGRFTMRRTVKSAPQSIWYGPDRPKYLGPFSEQTPSYLTGEFPGDYGWDTAGLSADPETFAKNRELEVIHSRWADAWRTRCVFPEILERTVSNSVKRSGSRRVPNFSEGGLDYLGNPNLIHAQSILAIWASQVVLMGLIEDIGLVVAHLVKGLTRFTQEAHLTHLDWLMTQMHLRS

SEQ ID NO: 7746 - protein, 207 aa, Platanus occidentalis
MATSAIQSSAFTGQTALKQQNELVRKVGVSGGRISMRRTVKSVAQSMWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLVHAQSILAIWACQVVLMGFVEGYRVGGGPLGKVWMQFTRVGHLTRLDWLMIQRLLPN

SEQ ID NO: 7747 - protein, 265 aa, Podocarpus macrophillus
MAAASAFQMSSFAGKSLFSPQNELVRKVGTSQGRVFMRRTVKSAPQSIWYGPDRPKYLGPFSEQTPSYLTGEFPGDYGWDTAGLSADPETFAKNRELEVIHCRWAMLGALGCVFPEILAKNGVKFGEAVWFKAGAQIFSEGGLDYLGNPNLIHAQSILAIWACQVVLMGLIEGYRVGGGPLGEGLDPLYPGGAFDPLGLADDPEQFAELKVKEIKNGRLAMFSMFGFFVQAIVTGKGPIENLFDHLADPAANNAWAYATNFVPGK

SEQ ID NO: 7748 - protein, 264 aa, Tamarix hispida
MATSAIQQSAFAGQTILKQQTELLRKVGGNGGRVSMRRTVKSAPESIWYGPDRPKYLGPFSEQTPSYLTGEFPGDYGWDTAGLSADPETFARNRELEVIHCRWAMLGALGCVFPEILSKNGVKFGEAVWFKAGAQIFQEGGLDYLGNPNLIHAQSILAIWACQVVLMGLVEGYRVSGGPLGEGLDQIYPGGAFDPLGLADDPEAFAELKVKEIKNGRLAMFSMFGFFVQAIVTGKGPVENLFDHVADPVANNAWAYATNFVPGK

SEQ ID NO: 7749 - protein, 265 aa, Phaseolus vulgaris
MATSAFQQSAFAGQTALKQVNEFVRKTGGSGKGRTNMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLVHAQSILAIWAVQVVLMGFVEGYRVGGGPLGEGLDPVYPGGSFDPLGLADDPDAFAELKVKELKNGRLAMFSMFGFFVQAIVTGKGPIQNLYDHVADPVANNAWAYATNFVPGQ

SEQ ID NO: 7750 - protein, 265 aa, Arabidopsis lyrata
MATSAIQQSSFAGQTALKPSNDLLRKAGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVVLMGFIEGYRIGGGPLGEGLDPLYPGGAFDPLNLAEDPEAFSELKVKELKNGRLAMFSMFGFFVQAIVTGKGPIENLFDHLADPVANNAWSYATNFVPGK

SEQ ID NO: 7751 - protein, 266 aa, Arabidopsis lyrata
MATSAIQHSSFAGQTALKPSNDLIRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFSELKVKELKNGRLAMFPMFGFFVQAIVTGKGPIENLFDHIADPVANNAWAYATNFVPGK

SEQ ID NO: 7752 - protein, 265 aa, Arabidopsis thaliana
MATSAIQQSSFAGQTALKPSSDLIQKVGVLGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVVLMGFIEGYRIGGGPLGEGLDPLYPGGAFDPLNLAEDPEAFSELKVKELKNGRLAMFSMFGFFVQAIVTGKGPIENLFDHLADPVANNAWSYATNFVPGK

SEQ ID NO: 7753 - protein, 265 aa, Arabidopsis thaliana [sequence omitted]

SEQ ID NO: 7754 - protein, 266 aa, Arabidopsis thaliana
MATSAIQHSSFAGQTTLKPSNDLLRKIGASNGGGRIIMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGFIEGYRIGGGPLGEGLDPLYPGGAFDPLNLAEDPEAFSELKVKELKNGRLAMFSMFGFFVQAIVTGKGPIENLFDHIADPVANNAWAYATNFVPGK

SEQ ID NO: 7755 - protein, 266 aa, Unknown
  Sequence found in Organisms: Brassica napus, Brassica juncea, Brassica rapa
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7756 - protein, 265 aa, Brassica juncea
MATSAIQHSSFAGQTALKPSNDLLRKVGASNGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHLADPVANNAWAYATNFVPGK

SEQ ID NO: 7757 - protein, 266 aa, Brassica juncea
MATSAIQHSSFAGQTALKPSNDLLRKVGPSNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7758 - protein, 266 aa, Brassica juncea
MATSAIQHSSFAGQTALKPSNDLIRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7759 - protein, 266 aa, Brassica napus
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFAPVK

SEQ ID NO: 7760 - protein, 266 aa, Brassica napus
MATSAIQHSSFTGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7761 - protein, 265 aa, Vigna unguiculata
MATTAFQQSAFAGQTALKQVNEFVRKTGGSGKGRTSMRRTVKSAPQSIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIQNLYDHVADPVANNAWAYATNFTPGQ

SEQ ID NO: 7762 - protein, 266 aa, Linum usitatissimum
MAATSGFQQSAFAGQITLNRSNERTRKVASLAGSRFNMRRTVKSAPQSIWYGADRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWACQVVLMGFVEGYRVGGGPLGEGLDPLYPGGSFDPLGLADDPEAFAELKVKEIKNGRLAMFSMFGFFVQAIVTGKGPVENLYDHIADPVANNAWAFATNFVPGK

SEQ ID NO: 7763 - protein, 265 aa, Arachis hypogaea
MATSAIQQSAFTGQTALKQGNELLRKIGGAGKGRINMRRTVKSTPQSIWYGPDRPKYLGPFSDQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWAVQVVLMGFVEGYRVGGGPLGEGLDPIYPGGAFDPLGLADDPEAFAELKVKELKNGRLAMFSMFGFFVQAIVTGKGPIQNLFDHVADPVANNAWAYATNFVPGQ

SEQ ID NO: 7764 - protein, 265 aa, Primula obconica
MATSAIQRSAFSGQTALKGQNELVRKVGSFGGGRVTMRRTVKSTSQSIWYGADRPKYLGPFSEQTPSYLTGEFPGDYGWDTAGLSADPETFAKNRELEVIHSRWAMLGALGCVFPELLAKNGVTFGESVWFKAGAQIFSEGGLDYLGNPNLIHAQSILAIWASQVVLMGFVEGYRIGGGPLGEGLDKIYPGGSFDPLGLADDPEAFAELKVKELKNGRLAMFSMFGFFVQAIVTGKGPIENLYDHLADPVANNAWAYATNFVPGN

SEQ ID NO: 7765 - protein, 266 aa, Raphanus sativus
MATSAIQHSSFAGQTALKPYNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7766 - protein, 265 aa, Tabernaemontana elegans
MATSGIQQSAFAGQTALKPQNELVRKIGSLGAGRFTMRRTVRSAPPSIWYGPDRPKYLGPFSEQTPRYLTGEFPGDYGWDTAGLSADPETFAKNRELEVIHCRWAMLGALGCVFPEILSRNGVKFGEAIWFKAGSQIFSEGGLDYLGNPNLIHAQSILAIWATQVVLMGLIEGYRVGGGPLGEGLDKIYPGGAFDPLGLADDPEAFAELKVKEIKNGRLAMFSMFGFFVQAIVTGKGPIENLYDHLADPVTNNAWAYATNFVPGK

SEQ ID NO: 7767 - protein, 265 aa, Eutrema parvulum
MATSAIQQSSFSGQTALKPSNDLLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGLIEGYRIGGGPLGEVLDPLYPGGAFDPLNLAEDPEAFSELKVKELKNGRLAMFSMFGFFFQAIVTGKGPIENLFDHLADPVANNAWSFATNFVPGK

SEQ ID NO: 7768 - protein, 265 aa, Trigonella foenum-graecum
MATSAIQQSAFTGKTGLRQRNEFIRKAGNFGQSRFTMRRTVKSAPESIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWATQVVLMGFVEGYRVGGGPLGEGLDPLYPGGAFDPLGLADDPDAFAELKVKELKNGRLAMFSMFGFFVQAIVTGKGPVQNLYDHIADPVANNAWAYATNFVPGQ

SEQ ID NO: 7769 - protein, 265 aa, Vinca minor
MATSGIQQSAFAGQTLLKSQNELIRKVGNVGGGRFTMRRTVKSSPQSIWYGPDRPKYLGPFSEQTPSYLTGEFPGDYGWDTAGLSADPETFAKNRELEVIHCRWAMLGALGCVFPEILSRNGVKFGEAVWFKAGSQIFSEGGLDYLGNPNLIHAQSILAIWASQVVLMGLIEGYRVGGGPLGEGLDKVYPGGAFDPLGLADDPEAFAELKVKEIKNGRLAMFSMFGYFVQAIVTGKGPIENLFDHIADPVANNAWAYATNFVPGK

SEQ ID NO: 7770 - protein, 143 aa, Bruguiera gymnorhiza
MATSSIQHSAFAGQTVLRHSNELARKVGSFGGGRVAMRRTVKSAPQSIWYGPDRPKYLGPFSEQTPSYLTGEFPGDYGWDTAGLSADPETFARNRELEVIHCRWAMLGALGCVFPEILSKNGVKFGEAVWFKAGASNFLRGWP

SEQ ID NO: 7771 - protein, 122 aa, Euphorbia peplus
MATSGIQQSAFAGQIALKPSNDLLRKVGNLGGARVVMRRTVKSAPESIWYGPNRPKYLGPFSEQTPSYLTGEFPGDYGWDTAGLSADPETFAKNRELEVSTANGLCLELSAVSSRKSSQRTV

SEQ ID NO: 7772 - protein, 78 aa, Flaveria ramosissima
IINSQPPYSNGDLLAIQQSAFAGSAALKPQNELVKRPAASTAAASPCAEPSKVHHKAYGMGRTGPSTWALSRSKPHLT

SEQ ID NO: 7773 - protein, 264 aa, Distylium racemosum
MAASAFQISSFSGKALLSPQNELLRKVGTSQGRVFMRRTIKSAPQSMWYGPDRPKYLGPFSEQTPSYLTGEFPGDYGWDTAGLSADPETFAKNRELEVIHCRWAMLGALGCVFPEILAKSGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLFDHLADPATNNAWAYATNFVPGK

SEQ ID NO: 7774 - protein, 174 aa, Secale cereale
CAGPSRARPTSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPSARASTSSTRAAPSTRLASPTTPTPPPSSR

SEQ ID NO: 7775 - protein, 231 aa, Pseudoroegneria spicata
SPCAGTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQAIVTGKGPVENLFDHVADPVNNNAWAFATNFAPGS

SEQ ID NO: 7776 - protein, 266 aa, Brassica juncea
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHLADPVANNAWAYATNFVPGK

SEQ ID NO: 7777 - protein, 266 aa, Brassica juncea
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLLDHVADPVANNAWAYATNFVPGK

SEQ ID NO: 7778 - protein, 266 aa, Brassica napus
MATSVIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7779 - protein, 101 aa, Phalaenopsis aphrodite
MAISAIQGSAFTGQTALKQPNELFRKVGSVGNGGRITMRRTVKSVPQSIWYGPDRPKYLGPFSEQTPSYLTGEFPGDYGWDTAGLSADPEPSLKPRAGGDP

SEQ ID NO: 7780 - protein, 265 aa, Acacia harpophylla
MATSAIHHAAFFGQTGLKQLNELVRKAGGPEVGRFTMRRAVKSAPQSIWYGPDRPKYLGPFSDQIPSYLTGEFPGDYGWDTAGLSADPETFARNRELEVIHCRWAMLGALGCVFPEILEKNGVKFGEAVWFKAGAQIFSEGSLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIQNLFDHVADPVANNAWAYATNFVPGQ

SEQ ID NO: 7781 - protein, 262 aa, Brassica napus
MATSAIQHSSFAGQTALKPSNDLLRKVGASNGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFV

SEQ ID NO: 7782 - protein, 265 aa, Trifolium pratense
MATSAIQQSAFTGKTGLRQGNEFIRRAGNFGPARLTMRRTVKSAPESIWYGPDRPKYLGPFSEQIPSYLTGEFPGDYGWDTAGLSADPETFAKNRELEVIHSRWAMLGALGCTFPEILEKNGVKFGEAVWFKAGAQIFSEGGLDYLGNPNLIHAQSILAIWATQVVLMGFVEGYRIGGGPLGEGLDPLYPGGAFDPLGLADDPDAFAELKVKELKNGRLAMFSMFGFFVQAIVTGKGPVQNLYDHLADPVANNAWAYATNFVPGQ

SEQ ID NO: 7783 - protein, 265 aa, Medicago truncatula
MATSAIQQSAFTGKTGLKQGNEFIRKAGSFGQSRFTMRRTVKSAPESIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWATQVVLMGFVEGYRVGGGPLGEGLDPLYPGGAFDPLGLADDPDAFAELKVKELKNGRLAMFSMFGFFVQAIVTGKGPVQNLYDHVADPVANNAWAYATNFVPGQ

SEQ ID NO: 7784 - protein, 265 aa, Pisum sativum
MATSAIQQSAFTGKTGLRQGNEFIRKAGNFGQARFTMRRTVKSAPESIWYGPDRPKYLGPFSEQIPSYLTGEFPGDYGWDTAGLSADPETFARNRELEVIHSRWAMLGALGCTFPELLEKNGVKFGEAVWFKAGSQIFAEGGLDYLGNPNLIHAQSILAIWATQVVLMGFVEGYRVGGGPLGEGLDPLYPGGAFDPLGLADDPDSFAELKVKELKNGRLAMFSMFGFFVQAIVTGKGPIQNLYDHVADPVANNAWAFATNFVPGQ

SEQ ID NO: 7785 - protein, 192 aa, Tamarix hispida
MATSAVQQSTFAGQSVLKQQNELVRKVGGNGGRVSMRRTVKSVPESIWYGPDRPKYLGPFSEQTPSYLTGEFPGDYGWDTAGLSADPETFARNRELEVIHCRWAMLGALGCVFPEILSKNGVKFGEAVWFKAGAQIFQEGGLDYLGNPNLIHAQSILAIWACQVVLMGLVEGYRVSGGPLREGLDKIYPGGA

SEQ ID NO: 7786 - protein, 251 aa, Conyza canadensis
ATLKPQNELVKKTGSFNGGRFTMRRTVKSAPQSIWYGPDRPKYLGPFSEQTPSYLTGEFPGDYGWDTAGLSADPETFAKNRELEVIHSRWAMLGALGCVFPEVLSKNGVKFGEAVWFKAGSQIFSEGGLDYLGNPNLVHAQSILAIWASQVVLMGLIEGYRVGGGPLGEGLDKVYPGGSFDPLGLADDPEAFAELKVKELKNGRLAMFSMFGFFVQAIVTGKGPLENLADHLADPVANNAWSYATNFVPGK

SEQ ID NO: 7787 - protein, 271 aa, Tropaeolum majus
MAATSAIQQSAFSGQTALKQSNELLIKVGALGDGRITMRRTVRSTPQSIWYGADRPKYLGPFSEQTPSYLTGEFPGDYGWDTAGLSADPETFAKNRELEVIHSRWAMLGALGCVFPEILSKNGVTFGEAVWFKAGSQIFSEGGLDYLGNPNLVHAQSILAIWATQVVLMGFVEGYRVGGGPLGEGLDPLYPGGAFDPLGLADDPEAFAELKVKELKNGRLAMFSMFGFFVQAIVTGKGPIENLSDHIADPVANNAWAFATNFVPGNEENPI

SEQ ID NO: 7788 - protein, 76 aa, Flaveria ramosissima
MGLIEGYRVGGGPLGEGLDKIYPGGSFDPLGLADDPDAFAELKVKELKNGRLAMFSYVWVLRSGHRYRKRPDRELV

SEQ ID NO: 7789 - protein, 266 aa, Brassica juncea
MATSAIQHSSFAGQTALKPSNDLLRKVGASNGGGRVVMRRTVKSTPQSIWYGPDRPKYLGPFSENTPSYLTGEYPGDYGWDTAGLSANPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVASNAWAYATNFVPGK

SEQ ID NO: 7790 - protein, 209 aa, Phalaenopsis aphrodite
MAISAIQGSAFTGQTALKQPNELFRKVGSVGNGGRITMRRTVKSVPQSIWYGPDRPKYLGPFSEQTPSYLTGEFPGDYGWDTAGLSADPETFAKNRELEVIHSRWAMLGALGCVFPSSSPERGEVRRSRLVQGRGPNLLRRRPGLPRQSEPHPCPEHPSYMGFSSHPHGLRRGISCWRRPAWGGGWIRSTLRGPSTHWALRMTRRPSRS

SEQ ID NO: 7791 - protein, 266 aa, Eutrema halophilum
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHLADPVANNAWSYATNFVPGK

SEQ ID NO: 7792 - protein, 75 aa, Brassica rapa
MIKQVLNRTFTSNNSLDKESKHREHGKPTVLELLHFQLRERLWILGQVQRVKRPTRVKRVKTFTKGPTSDSVPFD

SEQ ID NO: 7793 - protein, 98 aa, Flaveria ramosissima
MGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7794 - protein, 265 aa, Cicer arietinum
MATSAIQQSAFTGKTGLRQGNEFIRKAGSFGQGRFTMRRTVKSTPESIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWATQVVLMGFVEGYRVGGGPLGEGLDPLYPGGAFDPLGLADDPDAFAELKVKEIKNGRLAMTSMFGFFVQAIVTGKGPIQNLYDHVADPVANNAWAFATNFVPGQ

SEQ ID NO: 7795 - protein, 264 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPEN

SEQ ID NO: 7796 - protein, 264 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPAN

SEQ ID NO: 7797 - protein, 266 aa, Pinus taeda
MATASAIQSSSLAGQTLLRPQQNELVKKVGASQARITMRRTVRSAPESIWYGPDRPKYLGPFSEQTPSYLTGEFPGDYGWDTAGLSADPETFAKNRELEVIHSRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPVENLYDHLADPVANNAWAYATNFVPGK

SEQ ID NO: 7798 - protein, 266 aa, Pseudotsuga menziesii
MATASAIQSSSLAGQTLLRPQQNELVRKVGASQARITMRRTVRSAPESIWYGPDRPKYLGPFSEQTPSYLTGEFPGDYGWDTAGLSADPETFAKNRELEVIHSRWAMLGALGCVFPELLAKNGVKFGEAVWFKAGAQIFSEGGLDYLGNPNLIHAQSILAIWAFQVVLMGLIEGYRVGGGPLGEGLDPLYPGGAFDPLGLADDPEAFAELKVKELKNGRLAMFSMFGFFVQAIVTGKGPIENLFDHLADPTANNAWAYATNFVPGK

SEQ ID NO: 7799 - protein, 264 aa, Silene vulgaris
MATSTIQQSGFVGQTILKPQNELVRKVGGNGGRVSMRRTIKSAPESIWYGPDRPKYLGPFSEQTPSYLTGEFPGDYGWDTAGLSADPETFAKNRELEVIHCRWAMLGALGCVFPELLAKNGVKFGEAVWFKAGSQIFQEGGLDYLGNPNLVHAQSILAIWACQVVLMGAVEGYRVGGGPLGEGLDQLYPGGAFDPLGLAEDPEAFAELKVKEIKNGRLAMFSMFGYFVQAIVTGKGPVENLYDHLADPVANNAWAYATNFVPGK

SEQ ID NO: 7800 - protein, 61 aa, Zostera marina
MATSAIHQSVFVGQTTLKQQNELVRKVGVFESRISMRRTVKSTPDSVWYGADRPKYLGSIL

SEQ ID NO: 7801 - protein, 90 aa, Tripterygium wilfordii
MRRTVKSAPQSIWYGPDRPKYLGPFSEQTPSYLTGEFPGDYGWDTAGLSADPETFAKNRELEVIHSRWAMLGALGCVFPEILSKNGVKFG

SEQ ID NO: 7802 - protein, 210 aa, Raphanus sativus
MATSAIQHSSFAGQTALKSSNDLLRKVGAASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEILRRFPN

SEQ ID NO: 7803 - protein, 106 aa, Brassica rapa
MLLALPICCGLLRAHGSLRMFLGQLRDRLCPNRSLRGILRLGTMVCSPRMVLSTWDGLVQPDALRSRLDGTTHDDAATAVRSSYFAEEIVGGLQGRLAGERGVLDC

SEQ ID NO: 7804 - protein, 151 aa, Brassica napus
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKTESNSVKPCGSRQGLRSSQKEGLITSATLT

SEQ ID NO: 7805 - protein, 214 aa, Brassica napus
MATSAIQHSSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVRS

SEQ ID NO: 7806 - protein, 265 aa, Cicer arietinum
MATSAIQQSAFTGKTGLRQGNEFIRKAGSFGQGRFTMRRTVKSTPESIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHSQSILAIWATQVVLMGFVEGYRVGGGPLGEGLDPLYPGGAFDPLGLADDPDAFAELKVKEIKNGRLAMTSMFGFFVQAIVTGKGPIQNLYDHVADPVANNAWAFATNFVPGQ

SEQ ID NO: 7807 - protein, 261 aa, Aquilegia formosa
MATSVAFAGQIALKPQNELVRKVGNLGNGRFSMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGSQIFAEGGLDYLGNPNLVHAQSILAIWASQVVLMGLIEGYRVGGGPLGEGLDSLYPGGAFDPLGLADDPDSFAELKVKELKNGRLAMTSMFGFFVQAIVTGKGPIENLYDHLADPATNNAWAYATNFVPGK

SEQ ID NO: 7808 - protein, 202 aa, Picea glauca
MATASAIQISSLAGQTLLRPQQNELVSKVGASQARITMRRTVRSAPESIWYGPDRPKYLGPFSEQTPSYLTGEFPGDYGWDTAGLSADPETFAKNRELEVIHSRWAMLGALGCVFPELLAKTGVKFGEAVWFKAGAQIFSEGGLDYLGNPNLIHAQSILAIWAFQVVLMGLIEGYRVWGRTPWGGVGPSVPRGGLRSTGAGR

SEQ ID NO: 7809 - protein, 271 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKVQLRTYTTTLPTQSPTMLGPLLQTSPRQTKYNNLHI

SEQ ID NO: 7810 - protein, 67 aa, Zostera marina
MATSAIHQSVFVGQTTLKQQNELVRKVGVFESRISMRRTVKSTPDSVWYGADRPSTWVHSLSKLHHT

SEQ ID NO: 7811 - protein, 144 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLTT

SEQ ID NO: 7812 - protein, 271 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKVQLRTYTTTLPTQSPTMLGPLLQISPPQTKYNNLHI

SEQ ID NO: 7813 - protein, 264 aa, Mesembryanthemum crystallinum
MATSTIQQSAFAGQTVLKSQNELVRKVGGNGGRVAMRRTIKSAPESMWYGEDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWASQVVLMGLIEGYRVGGGPLGEGLDQLYPGGAFDPLGLADDPEAFAELKVKEIKNGRLAMFSMFGFFVQAIVTGKGPIENLYDHLADPVANNAWAFATNFVPGK

SEQ ID NO: 7814 - protein, 264 aa, Epimedium sagittatum
MAASGFQYSALSGRSLVTTKNEFVRKIGGFRSKIVMRRTVKSTPQSIWYGADRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWASQVVLMGFIEGYRVGGGPLGEGLDSLYPGGAFDPLGLADDPEAFAELKVKEIKNGRLAMTSMFGFFVQAIVTGKGPIENLFDHIADPTVNNAWAYATNFVPGK

SEQ ID NO: 7815 - protein, 250 aa, Linum usitatissimum
TLNRSNERTRKVAALGGSRFNMRRTVKSAPQSIWYGADRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWACQVVLMGFVEGYRVGGGPLGEGLDPLYPGGSFDPLGLADDPEAFAELKVKEIKNGRLAMFSMFGFFVQAIVTGKGPVENLYDHIADPVANNAWAFATNFVPGK

SEQ ID NO: 7816 - protein, 266 aa, Senecio madagascariensis
MATIQHSAFAGQSALKPQNELAKKVGGFNGGRFTMRRTVKSAPQSIWYGPDRPKYLGPFSEQTPSYLTGEFPGDYGWDTAGLSADPETFAKNRELEVIHSRWAMLGALGCIFPELLSKNGVKFGEAVWFKAGSQIFSEGGLDYLGNPNLVHAQSILAIWATQVVLMGLIEGYRVGGGPLGEGLDSIYPGGSFDPLGLADDPEAFAELKVKELKNGRLAMFSMFGFFVQAIVTGKGPIENLFDHLSDPAANNAWAYATNFVPRPRPR

SEQ ID NO: 7817 - protein, 266 aa, Cedrus atlantica
MATASAIHSSSLAGQSLLRSQGNELVKKAGMSQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWACQVVLMGLIEGYRVGGGPLGEGLDPLYPGGSFDPLGLADDPEAFAELKVKEIKNGRLAMFSMFGFFVQAIVTGKGPIENLFDHLADPTANNAWAYATNFVPGK

SEQ ID NO: 7818 - protein, 256 aa, Euphorbia peplus
SAFAGQIALKPSNDLLRKVGNLGGARVVMRRTVKSAPESIWYGPDRPKYLGPFSEQTPSYLTGEFPGDYGWDSAGLSADPETFAKNRELEVIHCRWAMLGALGCVFPEILSKNGVKFGEAVWFKAGSQIFSEGGLDYLGNPNLIPLSILAIWACQVVLMGFVEGYRVGGGPLGEGLDPLYPGGAFDPLGLADDPEAFAELKVKEIKNGRLAMFSMFGFFVQAIVTGKGPVENLYDHVADPVANNAWAFATNFVPGK

SEQ ID NO: 7819 - protein, 266 aa, Pinus pinaster
MATASAIQSSSLAGQTLLRPQQNELVGKVGASQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLFDHLADPTANNAWAYATNFVPGK

SEQ ID NO: 7820 - protein, 259 aa, Phalaenopsis aphrodite
GSAFTGQTALKQPNELFRKVGSVGNGGRITMRRTVKSVPQSIWYGPDRPKYLGPFSEQTPSYLTGEFPGDYGWDTAGLSADPETFAKNRELEVIHSRWAMLGALGCVFPELLSRNGVKFGEAVWFKAGAQIFSEGGLDYLGNPNLIHAQSILAIWASQVILMGFVEAYRVGGGPLGEGLDKIYPGGAFDPLGLADDPEAFAELKVKELKNGRLAMFSMFGFFVQAIVTGKGPIENLYDHLADPTTNNAWAYATNFVPGK

SEQ ID NO: 7821 - protein, 265 aa, Papaver somniferum
MATSAIQRSAFAGQTALKQQNEFIRKVGNVEGGRISMRRTVKSIQSSMWYGPDRPKYLGPFSEQTPSYLTGEFPGDYGWDTAGLSADPETFAKNRELEVIHCRWAMLGALGCVFPEVLSKNGINFGEAVWFKAGSQIFSEGGLDYLGNPNLVHAQSILAIWATQVVLMGFVEGYRVGGGPLGEGLDKLYPGGSFDPLGLADDPESFSELKVKEIKNGRLAMFSMFGYFVQAIVTGKGPIENLYDHIADPVANNAWAYATNFAPGK

SEQ ID NO: 7822 - protein, 266 aa, Picea glauca
MAAASAIQSSSLAGQTLLRPQHNELVRKVGMSQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWASQVVLMGLIEGYRVGGGPLGEGLDPLYPGGAFDPLGLADDPESFAELKVKEIKNGRLAMFSMFGFFVQAIVTGKGPIENLYDHLADPTANNAWAYATNFVPGK

SEQ ID NO: 7823 - protein, 171 aa, Cicer arietinum
MATSAIQQSAFTGKTGLRQGNEFIRKAGSFGQGRFTMRRTVKSTPESIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWATQVVLMGVC

SEQ ID NO: 7824 - protein, 202 aa, Picea glauca
MATASAIQISSLAGQTLLRPQQNELVSKVGASQARITMRRTVRSAPESIWYGPDRPKYLGPFSEQTPSYLTGEFPGDYGWDTAGLSADPETFAKNRELEVIHSRWAMLGALGCVFPELLAKTGVKFGEAVWFKAGAQIFSEGGLDYLGNPNLIHAQSILAIWAFQVVLMGLIEGYRVRGRTPWGGVGPSVPRGGLRSTGAGR

SEQ ID NO: 7825 - protein, 76 aa, Zostera marina
RTQQKLFVLFHFEAQGMATSAIHQSVFVGQTTLKQQNELVRKVGVFESRISMRRTVKSTPDSVWTAQTVQVLGSIL

SEQ ID NO: 7826 - protein, 264 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFQSFYQRTELNSVKSVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPAN

SEQ ID NO: 7827 - protein, 71 aa, Zostera marina
LFVLFHFEAQGMATSAIHQSVFVGQTTLKQQNELVRKVGVFESRISMRRTVKSTPDSVWTAQTVPSTGSIL

SEQ ID NO: 7828 - protein, 160 aa, Zostera marina
MLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPAN

SEQ ID NO: 7829 - protein, 270 aa, Taxus baccata
MAAAFQLSSMGSFAGQSLFQPKNEFARYLAISVGSFESRINMRRTIKSTPQSLWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWASQVVLMGLIEGYRVGGGPLGEGLDPLYPGGAFDPLGLADDPEAFAELKVKELKNGRLAMFSMFGFFVQAIVTGKGPIENLYDHLADPATNNAWAYATNFVPGK

SEQ ID NO: 7830 - protein, 160 aa, Flaveria ramosissima
MLGALGCVFPEILEKNGVKFGEAVWFKAGSQIFSEGGLDYLGNPNLIHAQSILAIWATQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7831 - protein, 229 aa, Valeriana officinalis
MRRTVKSAPQSIWYGPDRPKYLGPFSEQTPSYLTGEFPGDYGWDTAGLSADPETFAKNRELEVIHSRWAMLGALGCVFPEILSKNGVKFGEAVWFKAGSQIFSEGGLDYLGNPNLVHAQSILAIWASQVVLMGLIEGYRVGGGPLGEGLDSLYPGGAFDPLGLADDPESFAELKVKELKNGRLAMFSMFGFFVQAIVTGKGPVENLYDHVADPVANNAWAFATNFVPGK

SEQ ID NO: 7832 - protein, 248 aa, Cichorium intybus
LKPQNELSRKPHLQWRPLHHAPHRQKCTTKHLYGPDRPKYLGPFSEQTPSYLTGEFPGDYGWDTAGLSADPETFAKNRELEVIHSRWAMLGALGCVFPEILSKNGVTFGEAVWFKAGSQIFSEGGLDYLGNPNLIHAQSILAIWASQVVLMGLIEGYRVGGGPLGEGLDKIYPGGSFDPLGLADDPEAFAELKVKELKNGRLAMFSMFGFFVQAIVTGKGPIENLSDHLSDPVANNAWAYATNFVPGK

SEQ ID NO: 7833 - protein, 181 aa, Flaveria ramosissima
KTGSFNGGRSPCAEPSRAHHKALVWPDRPSIWPVLGANPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGTALVEAHWVKGSTRFTQVGLLTHLVWLMIRMLLLN

SEQ ID NO: 7834 - protein, 160 aa, Flaveria ramosissima
MLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKGPIENLFDHVSDPVANNAWAYATNFVPGK

SEQ ID NO: 7835 - protein, 875 aa, Brassica rapa
MEISVSSPKQSVLSSSDCMSDPEEEHEISEEEDDDDRNHKHRKKEETSSQSLEQGSSDQAFSRPYRRNYKHFENGNEHEKRSLGAGGSGHRVQFDNQRSRSNPGRGRGSYGSWSQRDSRFNHPVDLSSHMVPGMFGGRGIAAQTAPWPGFGMLPGVPNGGLDGFHHLQGPLGPPLNGPLNMGIPRQRCRDFEERGFCLRGDMCPMEHGINRIVVDDVQSLSQFNLPVSVPGAPHMAASSKPVPAQFGGANFMNTKGAHGKTNETGMAVDGMGYGDAYPSAGGTDSYDPDQPLWNNSAGETSGALSALNSHGIDENVAPMDDNNQDGPVNTYGIRESRNNNQSGWGRVRNSQANLKEKGDTVLNSSAGPEGQSKEISVSLSRQNNVGGSVAKAVDSSNASNDAVNNTRTPMQKAMRTLFVNGVPHESNRRDLILAHFQKFGKVIDIHIPVNSNRAFVQFSKREEAESALRAPDAVMGNRFIKLWWANRDSIPDNGLSSGNGAFMKGRVVGASGGQNQIPISAASKSNHVSLTAKGPAFHPGGAPSSSQQPKPVGVTSGPKVMPLQQKKADTLEQLKETLRKKQEMLDQKRNELCKKLATLQKQETGVKDEEADEPDAKRVKVDTASNSGTAIPSPKTESLTEKKGPIKKPLSIARPSTETPSPDLKNLKQRPYSYTTSLNTPMVNRYKLDNRTTTIKVVPPLPTGLADVAVLKEHFSSYGEVSKVELEDNASADSGKDQDETHNKSLAACVTFVKRSAAEKAFANAKSWQEHTLQLVWVTRQIKKENKSSNDKNNPSVSSDHLSSKNKSAASVSNDPKPEDEVKSSSTEEPKSTNVSGDDNTLNEQDNGSNKSNSESNEGAEKVAAPESDEEQMNG

SEQ ID NO: 7836 - protein, 266 aa, Abies balsamea
MATASAIHSSSLAGQTLLRPQQNELVKKVGTSQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWAFQVVLMGLIEGYRVGGGPLGEGLDPLYPGGAFDPLGLADDPEAFAELKVKEIKNGRLAMFSMFGFFVQAIVTGKGPIENLYDHLADPTANNAWAYATNFVPGK

SEQ ID NO: 7837 - protein, 260 aa, Brassica juncea
QHSSSTGQTALKPSNDLLRKVGASSGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7838 - protein, 266 aa, Cedrus atlantica
MATASAIHSSSLAGQSLLRSPGNELVKKAGTSQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWACQVVLMGLIEGYRVGGGPLGEGLDPLYPGGSFDPLGLADDPEAFAELKVKEIKNGRLAMFSMFGFFVQAIVTGKGPIENLFDHLADPTANNAWAYATNFVPGK

SEQ ID NO: 7839 - protein, 163 aa, Artemisia annua
MATSAMQQSAFVGESALKPQNELVKKTGSFNGGRFTMRRTVKSAPQSIRPKYLGPFSEQTPSYLTGEFPGDYGWDTAGLSADPETFAKNRELEVIHSRWAMLGALGCVFPELLSKNGVKFGEAVWFKAGSQIFSEGGLDYLGNPNLIHAQSILAFTSSPYGTH

SEQ ID NO: 7840 - protein, 209 aa, Picea glauca
MATASAIQISSLAGQTLLRPQQNELVSKVGASQARITMRRTVRSAPESIWYGPDRPKYLGPFSEQTPSYLTGEFPGDYGWDTAGLSADPETFAKNRELEVIHSRWAMLGALGCVFPELLAKTGVKFGEAVWFKAGAQIFSEGGLDYLGNPNLIHAQSILAIWAFQVVLMGLIEGYRVGGGPLGRGWTLCTQGGPSIHWGWPMTRKRLRS

SEQ ID NO: 7841 - protein, 266 aa, Unknown
  Sequence found in Organisms: Cedrus atlantica, Pinus pinaster
MATASAIQSSSLAGQTLLRPQQNELVKKVGTSQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLYDHLADPTANNAWAYATNFVPGK

SEQ ID NO: 7842 - protein, 266 aa, Cedrus atlantica
MATASAIQSSTLAGQTLLKPQQNELVKKVGTSQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLFDHLADPAANNAWAYATNFVPGK

SEQ ID NO: 7843 - protein, 266 aa, Pinus taeda
MATASAIQSSSFAGQTLLRPQQNELVKKVGTSQARITMRRTVRSAPESIWYGPDRPKFLGPFSEQTPSYLTGEFPGDYGWDTAGLSADPETFAKNRELEVIHSRWAMLGALGCVFPELLAKTGVKFGEAVWFKAGAQIFSEGGLDYLGNPNLIHAQSILAIWAFQVVLMGLIEGYRVGGGPLGEGLDPLYPGGAFDPLGLADDPEAFAELKVKEIKNGRLAMFSMFGFFVQAIVTGKGPIENLYDHLADPVANNAWAYATNFVPGK

SEQ ID NO: 7844 - protein, 266 aa, Pinus taeda
MATASAIQSSSLAGQTLLRPQQNELVKKVGTAQARITMRRTVRSAPESIWYGPDRPKYLGPFSEGTPSYLTGEFPGDYGWDTAGLSADPETFAKNRELEVIHSRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLYDHLADPAANNAWAYATNFVPGK

SEQ ID NO: 7845 - protein, 265 aa, Papaver somniferum
MATTAIQRSAFTGQTALKQQNEFIRKVGNVEGGRISMRRTVKSIQSSMWYGPDRPKYLGPFSEQTPSYLTGEFPGDYGWDTAGLSADPETFAKNRELEVIHCRWAMLGALGCVFPEVLSKNGINFGEAVWFKAGSQIFSEGGLDYLGNPNLVHAQSILAIWATQVVLMGFVEGYRVGGGPLGEGLDKLYPGGSFDPLGLADDPESFSELKVKEIKNGRLAMFSMFGYFVQAIVTGKGPIENLYDHIADPVANNAWAYATNFAPGK

SEQ ID NO: 7846 - protein, 266 aa, Pseudotsuga menziesii
MATTSAIQSASLAGQTLLRPQQNELVRKVGASQARITMRRTVRSAPESIWYGPDRPKFLGPFSEQTPSYLTGEFPGDYGWDTAGLSADPETFARNRELEVIHSRWAMLGALGCVFPELLAKNGVKFGEAVWFKAGAQIFSEGGLDYLGNPNLIHAQSILAILASQVVLMGLIEGYRVGGGPLGEGLDPLYPGGSFDPLGLADDPEAFAELKVKELKNGRLAMFSMFGFFVQAIVTGKGPIENLFDHLADPVANNAWAYATNFVPGK

SEQ ID NO: 7847 - protein, 266 aa, Picea glauca
MAAASAIQSSSLAGQTLLRPHQNELVKKVGASQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWASQVVLMGLIEGYRVGGGPLGEGLDPLYPGGAFDPLGLADDPEAFAELKVKEIKNGRLAMFSMFGFFVQAIVTGKGPIENLFDHLADPTANNAWAYATNFVPGK

SEQ ID NO: 7848 - protein, 276 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFQELLSKNGVKLGESVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPEKLNITISIYNLHV

SEQ ID NO: 7849 - protein, 262 aa, Vaccinium corymbosum
MATSAIQQSAFLGSRAASKRRVKKVSGFTAGRIMMRRTVKVFPKAYGMDRTAQVLGPFSEQTPSYLTGEFPGDYGWDTAGLSADPETFAKNRELEVIHSRWAMLGALGCVFPEILAKNGVKFGESVWFKAGAQIFSEGGLDYLGNPNLIHAQSILAIWACQVVLMGFVEGYRVGGGPLGEGLDKIYPGGAFDPLGLADDPEAFAELKVKELKNGRLAMFSMFGFFVQAIVTGKGPIENLFDHLADPVANNAWAYATNFVPGK

SEQ ID NO: 7850 - protein, 268 aa, Cephalotaxus harringtonia
MAVAFQVTSFFARQPLFQGDSGFARQLAVQVGSFESRINMRRTVKSLPQSLWYGADRPKYLGPFSEQTPSYLTGEFPGDYGWDTAGLSADPETFAKNRELEVIHCRWAMLGALGCVFPEILAKNGVKFGEAVWFKAGSQIFSEGGLDYLGNPNLIHAQSILAIWACQVVLMGLIEGYRVGGGPLGEGLDPVYPGGAFDPLGLADDPEAFAELKVKEIKNGRLAMFSMFGFFVQAIVTGKGPIENLFDHLADPSTNNAWAYATNFVPGK

SEQ ID NO: 7851 - protein, 264 aa, Epimedium sagittatum
MAASGFQYSALSGRSLVTSKNEFTRKIGGFRSKIVMRRTVKSTPQSIWYGEDRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWASQVVLMGLIEGYRVGGGPLGEGLDSLYPGGAFDPLGLADDPEAFAELKVKEIKNGRLAMTSMFGFFVQAIVTGKGPIENLFDHIADPTVNNAWAYATNFVPGK

SEQ ID NO: 7852 - protein, 265 aa, Papaver somniferum
MATSAIQQSAIAGQTALKQQNEFICKVGNIDGGRIYMRRTVKSIQQSMWYGPDRPKYLGPFSEQTPSYLTGEFPGDYGWDTAGLSADPETFAKNRELEVIHCRWAMLGALGCVFPEVLSKNGINFGEAVWFKAGSQIFSEGGLDYLGNPNLVHAQSILAIWATQVVLMGFVEGYRVGGGPLGEGLDKLYPGGSFDPLGLADDPESFSELKVKEIKNGRLAMFSMFGYFVQAIVTGKGPIENLYDHVADPVANNAWAYATNFVPGK

SEQ ID NO: 7853 - protein, 74 aa, Zostera marina
MRRTVKSTPDSVWYGADRPKYLGPFSEQTPSYLTGEFPGDYGWDTAGLSADPETFAKNRELEVIHCRWGPCWAP

SEQ ID NO: 7854 - protein, 268 aa, Cycas rumphii
MATVTSASAIQSSTLAGQTLLKPQNELLKKVGTSEGRITMRRTVKTAPQSIWYGPDRPKYLGPFSEQTPSYLTGEFPGDYGWDTAGLSADPETFAKNRELEVIHSRWAMLGALGCVFPEILARNGVKFGEAVWFKAGAQIFSEGGLDYLGNPNLVHAQSILAIWAVQVVLMGFVEGYRIGGGPLGEGLDPLYPGGAFDPLGLADDPEAFAELKVKELKNGRLAMFSMFGFYVQAIVTGKGPIENLFDHLADPTANNAWAYATNFVPGK

SEQ ID NO: 7855 - protein, 229 aa, Flaveria ramosissima
MRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKGPIENLFDHVSDPVANNAWAYATNFVPGK

SEQ ID NO: 7856 - protein, 268 aa, Silene vulgaris
MATSTIQQSAFAGQTILKPQNELVRKVGGNGGRVSMRRTIKSAPESIWYGPDRPKYLGPFSEQTPSYLTGEFPGDYGWDTAGLSADPETFAKNRELEVIHCRWAMLGALGCVFPELLAKNGVKFGEAVWFKAGSQIFQEGGLDYLGNPNLVHAQSILAIWACQVVLMGAVEGYRVGGGPLGEGLDQLYPGGAFDPLGLAEDPEAFAELKVKEIKNGRLAMFSMFGFFVQAIVTGKGPVENLYDHLADPVANNAWAYATNFVLSSTKLS

SEQ ID NO: 7857 - protein, 266 aa, Abies balsamea
MATASAIHSSSLAGQTLLRPQQNELVSKVGSSQARITMRRTVRSAPESIWYGPDRPKFLGPFSEQTPSYLTGEFPGDYGWDTAGLSADPETFAKNRELEVIHCRWAMLGALGCVFPELLAKSGVKFGEAVWFKAGAQIFSEGGLDYLGNPNLIHAQSILAVWASQVVLMGLIEGYRVGGGPLGEGLDPLYPGGAFDPLGLADDPEAFAELKVKEIKNGRLAMFSMFGFFVQAIVTGKGPIENLFDHLADPTANNAWAYATNFVPGK

SEQ ID NO: 7858 - protein, 258 aa, Brassica juncea
SSFAGQTALKPSNDLLRKVGASNGGGRVVMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHLADPVANNAWAYATNFVPGK

SEQ ID NO: 7859 - protein, 277 aa, Papaver somniferum
MATSAIQRSSIAGQTALKQQNELIRKVGNIDGGRISMRRTVKNIQQSMWYGPDRPKYLGPFSEQTPSYLTGEFPGDYGWDTAGLSADPETFAKNRELEVIHCRWAMLGALGCVFPEVLSKNGINFGEAVWFKAGSQIFSEGGLDYLGNPNLVHAQSILAIWATQVVLMGFVEGYRVGGGPLGEGQDKLYPGGSFDPLGLADDPESFSELKVKEIKNGRLAMFSMFGYFVQAIVTGKGPIENLYDHVADPVANNAWAYATKLFSWENECYTSGVYKAC

SEQ ID NO: 7860 - protein, 209 aa, Picea glauca
MAAASAIQSSSLAGQTLLRPQHNELVRKVGMSQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWASQVVLMGLIEGYRVGGGPLGEGWTLCTLEGPSIHWGWPMTQKRSRS

SEQ ID NO: 7861 - protein, 277 aa, Flaveria ramosissima
QQSIINSLSPYSNGDLCNPTVSIRRLRGVEATNELVKKTGSFNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKGPIENLFDHVSDPVANNAWAYATNFVPGK

SEQ ID NO: 7862 - protein, 266 aa, Pinus pinaster
MATASAIQSSSLAGQTLLRPQQNEFVKKVGASQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLYDHLADPTANNAWAYATNFVPGK

SEQ ID NO: 7863 - protein, 265 aa, Papaver somniferum
MATSAIQRSAIAGQTALKQQNELIRRVGNIDGGRISMRRTVKSIQQSMWYGPDRPKYLGPFSEKTPSYLTGEFPGDYGWDTAGLSADPETFAKNRELEVIHCRWGMLGALGCLFPEILSKNGINFGEAVWFKAGSQIFSEGGLDYLGNRNLVHAQSILAIWATQVVLMGFVEGYRVGGGPLGEGLDKLYPGGSFDPLGLADDPESFSELKVKEIKNGRLAMFSMFGYFVQAIVTGKGPIENLYDHVADPVANNAWAYATNFSPGK

SEQ ID NO: 7864 - protein, 265 aa, Papaver somniferum
MATTAIQRSAFAGQTALKQQNEFIRKVGNVEGGRISMRRTVKSIQSSMWFGPDRPKYLGPFSEQTPSYLTGEFPGDYGWDTAGLSADPETFAKNRELEVIHCRWAMLGALGCVFPEVLSKNGINFGEAVWFKAGSQIFSEGGLDYLGNPNLVHAQSILAIWATQVVLMGFVEGYRVGGGPLGEGLDKLYPGGSFDPLGLADDPESFSELKVKEIKNGRLAMFSMFGYFVQAIVTGKGPIENLYDHIADPVANNAWAYATNFAPGK

SEQ ID NO: 7865 - protein, 265 aa, Papaver somniferum
MATSAIQRSAVAGQTALKQQNELIRKVGNIDSGRISMHRTVKSIQQSMWYGPDRPKYLGPFSEQTPSYLTGEFPGDYGWDTAGLSADPETFAKNRELEVIHCRWAMLGALGCVFPEVLLKNGINFGEAVWFKAGSQIFSEGGLDYLGNPNLVHAQSILAIWATQVVLMGFVEGYRVGGGPLGEGLDKLYPGGSFDPLGIADDPESFSELKVKEIKNGRLAMFSMFGYFVQAIVTGKGPIENLYDHVADPVANNAWAYATNFAPGK

SEQ ID NO: 7866 - protein, 266 aa, Picea glauca
MATASAIQSSSLAGQTLLRPHQNELVKKVGASQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWASQVVLMGLIEGYRVGGGPLGEGLDPLYPGGAFDPLGLADDPEAFAELKVKEIKNGRLAMFSMFGFFVQAIVTGKGPIENLFDHLADPTANNAWAYATNFVPGK

SEQ ID NO: 7867 - protein, 266 aa, Picea glauca
MATASAIQSSSLAGQTLLRPHQNELVKKVGASQARITMRRTVRSAPESIWYGPDRPKYLGPFSEQTPSYLTGEFPGDYGWDTAGLSADPETFAKNRELEVIHSRWAMLGALGCVFPELLAKTGVKFGEAVWFKAGAQIFSEGGLDYLGNPNLIHAQSILAIWASQVVLMGLIEGYRVGGGPLGEGLDPLYPGGAFDPLGLADDPEAFAELKVKEIKNGRLAMFSMFGFFVQAIVTGKGPIENLYDHLADPTANNAWAYATNFVPGK

SEQ ID NO: 7868 - protein, 266 aa, Picea glauca
MAAASAIQSSSLAGQTLLRPHQNELVKKVGASQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWASQVVLMGLIEGYRVGGGPLGEGLDPLYPGGAFDPLGLADDPEAFAELKVKEIKNGRLAMFSMFGFFVQAIVTGKGPIENFFDHLADPTANNAWAYATNFVPGK

SEQ ID NO: 7869 - protein, 97 aa, Zostera marina
AQGMATSAIHQSVFVGQTTLKQQNELVRKVGVFESRISMRRTVKSTPDSVWYGADRPKYLGPFSEQTPSYLTGEFPGDYGWDTAGLSADPRDLRKEP

SEQ ID NO: 7870 - protein, 67 aa, Zostera marina
MATSAIHQSVFVGQTTLKQQNELVRKVGVFESRISMRRTVKSTPDSVWTAQTVPSTWVHSLSKLHHT

SEQ ID NO: 7871 - protein, 169 aa, Zostera marina
MGHVGALGCVFPELLSKNGVKFGRSRLVQAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPQTKYNNLHI

SEQ ID NO: 7872 - protein, 247 aa, Linum usitatissimum
RSNERTRKVASLAGSRFNMRRTVKSAPQSIWYGADRPKYLGPFSEQTPSYLTGEFPGDYGWDTAGLSADPETFAKNRELEVIHCRWAMLGALGCVFPEILSKNGVKFGEAVWFKAGAQIFSEGGLDYLGNPNLVHAQSILAIWACQVVLMGFVEGYRVGGGPLGEGLDPLYPGGSFDPLGLADDPEAFAELKVKEIKNGRLAMFSMFGFFVQAIVTGKGPVENLYDHIADPVANNAWAFAPNFVPGK

SEQ ID NO: 7873 - protein, 270 aa, Sequoia sempervirens
MAAAFQLSSLGSFAGQPLCQPKSEFARQIGISVGNFESRVNMRRTVKTAPQSLWYGPDRPKYLGPFSEQTPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWASQVVLMGLIEGYRVGGGPLGEGLDPLYPGGAFDPLGLADDPEAFAELKVKEIKNGRLAMFSMFGFFVQAIVTGKGPIENLYDHLADPSTNNAWAYATNFVPGK

SEQ ID NO: 7874 - protein, 83 aa, Flaveria ramosissima
MGLIEGYRVGGGPLGEGLDKIYPGGSFDPLGLADDPDAFAELKVKELKNGRLAMFSMFGFFVQAIVTGKGRSRTCLIMSAIRC

SEQ ID NO: 7875 - protein, 115 aa, Flaveria ramosissima
NGGRFTMRRTVKSAPQSIWYGPDRPKYLGPFSEQTPSYLTGEFPGDYGWDTAGLSADPETFAKNRELEVIHSRWAMLGALGCVFPEILEKNGVKFGEAVWFKAVPNFSQKAGLTT

SEQ ID NO: 7876 - protein, 184 aa, Quercus alba
MASSTIQRSAFAGQTALKQSNELVRKVGSFAGGRVTMRRTVKSAPQSIWYGPDRPKYLGPFSEQTPSYLTGEFPGDYGWDTAGLSADPETFARNRELEVIHSRWAMLGALGCVFPEVLSKNGVKFGEAVWFKAGAQIFSEGGLDYLGNPNLIHAQSILAIWAVQVVLMGFIEGYRVGGGPTWTG

SEQ ID NO: 7877 - protein, 209 aa, Picea glauca
MATASAIQSSSLAGQTLLRPHQNELVKKVGASQARITMRRTVRSAPESIWYGPDRPKYLGPFSEQTPSYLTGEFPGDYGWDTAGLSADPETFAKNRELEVIHSRWAMLGALGCVFPELLAKTGVKFGEAVWFKAGAQIFSEGGLDYLGNPNLIHAQSILAIWASQVVLMGLIEGYRVGGGPLGEGWTLCTLEGPSIHWGWPMTQKRSRS

SEQ ID NO: 7878 - protein, 151 aa, Picea glauca
MASASAIQSSSLAGQTLLRPQHNELVRKVGMSQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPN

SEQ ID NO: 7879 - protein, 181 aa, Flaveria ramosissima
RRPRRVRRKRASSTKTGAHAALTLRRTVKSAHKTIGMGRTTTPTYLGPFSEEPHHTNRRIPGDYGWDTAGLSADPEAFAKNRELEVIHSRWAMLGALGCVFPEILAKNGVKFGEAVWFRAGSQIFSEGGLDYLGNPNLIHAQSILAIWACQVVLMGLIEGYRVGGGPLGEGLDKIYPGGSF

SEQ ID NO: 7880 - protein, 229 aa, Ambrosia trifida
MRRTVKSAPQSIWYGPDRPKYLGPFSEQTPSYLTGEFPGDYGWDTAGLSADPETFAKNRELEVIHSRWAMLGALGCVFPEVLSKNGVKFGEAVWFKAGSQIFSEGGLDYLGNPNLIHAQSILAIWASQVVLMGLIEGYRVGGGPLGEGLDKIYPGGSFDPLGLADDPDAFAELKVKELKNGRLAMFSMFGFFVQAIVTGKGPIENLFDHLSDPVANNAWAYATNFVPGK

SEQ ID NO: 7881 - protein, 229 aa, Quercus alba
MRRTVKSAPQSIWYGPDRPKYLGPFSEQTPSYLTGEFPGDYGWDTAGLSADPETFARNRELEVIHSRWAMLGALGCVFPEVLSKNGVKFGEAVWFKAGAQIFSEGGLDYLGNPNLIHAQSILAIWAVQVVLMGFIEGYRVGGGPLGEGLDPIYPGGAFDPLGLADDPEAFAELKVKELKNGRLAMFSMFGFFVQAIVTGKGPIENLFDHVADPVANNAWAYATNFVPGK

SEQ ID NO: 7882 - protein, 292 aa, Selaginella moellendorffii
QTLSLHRPRCACSILRLPFFVLTLDMAASASAISSSSFSGQTALKSPNELSRKVGNLGEARTVMRRTRASTPDSIWYGPDRPKFLGPFSEQTPSYLTGEFPGDYGWDTAGLSADPETFAKNRELEVIHSRWAMLGALGCVTPELLAKNGIKFGEAVWFKAGSQIFKEGGLDYLGNPNLVHAQSILAIWASQVILMGAVEGYRVGGGPLGEGLDKIYPGGAFDPLGLADDPDTFAELKVKELKNGRLAMFSMFGFFTQAIVTGKGPIENLLDHLDNPTVNNAWAYATNFTPGS

SEQ ID NO: 7883 - protein, 271 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPQTKYNNLHI

SEQ ID NO: 7884 - protein, 271 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPKTKYNNLHI

SEQ ID NO: 7885 - protein, 248 aa, Centaurea maculosa
  misc_feature (230)..(230): Xaa can be any naturally occurring amino acid
MTASAIQQSAFAGQTALKQPNDLVRKVGSFGGGRVTMRRTVKSAPQSIWYGPDRPKFLGPFSEQTPSYLTGEFPGDYGWDTAGLSADPETFAKNSELEVIHSRWAMLGALGCVFPEILAKNGVKFGESVWFKAGAQIFSEGGLDYLGNPNLIHAQSILAIWASQVVLMGFVEGYRVGGGPLGEGLDPLYPGGAFDPLGLADDPDAFAELKVKELKNGRLAMFSMFGFFVXAIVTGKGPVENLLDHLAD

SEQ ID NO: 7886 - protein, 265 aa, Papaver somniferum
MATSAIQRSAIAGQTALKQQNELIRKVGNIDGGRISMRRTVKSIQQSMWYGPDRPKYLGPFLEQTPSYLTSEFPGDCGWDTAGLSSDPETFAKNRELEVIHCRWAMLGALGCVFPEVLSKNGINFGEAVWFKAGSQIFSEGGLDYLGNPNWVHAQSVLAIWATQVVLMGFVEGYRVGGGPLGEGLDKLYPGGSFDPLGLADDPESFSELKVKEIKNGRLAMFSMFGYFVQAIVTGKGPIENLYDHVADPVANNAWAYATNFAPGK

SEQ ID NO: 7887 - protein, 255 aa, Senecio madagascariensis
MASSSIQQSAFAGQSAVKPQNELLRKIGGFNGGRFTMRRTVKSAPQSIWYGADRPKYLGPFSEQTPSYLTGEFPGDYGWDTAGLSADPETFAKNRELEVIHSRWAMLGALGCVFPELLSKNGVKFGEAVWFKAGSQIFSEGGLDYLGNPNLDHAQSILAIWASQVVLMGLIEGYRVGGGPLGEGLDSIYPGGSFDPLGLADDPEAFAELKVKELKNGRLAMFFMFGVFVQAIVPGKAPIENLFDHVSDPVANNAW

SEQ ID NO: 7888 - protein, 265 aa, Picea glauca
MAAASAIQSSSLAGQTLLRPQHNELVRKVGMSQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWASQVVLMGLIEGYRVGEDPLGGLDPLYPGGAFDPLGLADDPEAFAELKVKEIKNGRLAMFSMFGFFVQAIVTGKGPIENLYDHLADPTANNAWAYATNFVPGK

SEQ ID NO: 7889 - protein, 237 aa, Sequoia sempervirens
MAAAFQLSSLGSFAGQPLCQPKSEFARQIGISVGNFESRVNMRRTIKTAPQSLWYGPDRPKYLGPFSEQTPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWASQVVLMGLIEGYRVGGGPLGEGLDPLYPGGAFDPLGLADDPEAFAELKVKEIKNGRLAMFSMFGFLCRLL

SEQ ID NO: 7890 - protein, 229 aa, Mimulus guttatus
MRRTVKSAPQSIWYGEDRPKYLGPFSEQTPSYLTGEFPGDYGWDTAGLSADPETFAKNRELEVIHSRWAMLGALGCVFPEVLSKNGVKFGEAVWFKAGSQIFSEGGLDYLGNPNLVHAQSILAIWATQVVLMGFVEGYRVGGGPLGEGLDKVYPGGSFDPLGLAEDPEAFAELKVKELKNGRLAMFSMFGFFVQAIVTGKGPIENLFDHLADPVANNAWAFATNFVPGK

SEQ ID NO: 7891 - protein, 243 aa, Picea glauca
MSSSVRWARRRLESPCEEPSGAPLRAFGMDLTAPSTWAPSRNRRRRISPANFPATTGGTPPGSLPTLRPSPKQRAGGDPQQMGHVGALGCVFPELLAKTGVKFGEAVWFKAGAQIFSEGGLDYLGNPNLIHAQSILAIWASQVVLMGLIEGYRVRGGPLGEGLDPLYPGGAFDPLGLADDPEAFAELKVKEIKNGRLAMFSMFGFFVQAIVTGKGPIENLYDHLADPTANNAWAYATNFVPGK

SEQ ID NO: 7892 - protein, 265 aa, Picea glauca
MTTASAIQSSSLAGQTLLRPHQNELVKKVGASQARITMRRTVRSAPESIWYGPDRPKYLGPFSEQTPSYLTGEFPGDYGWDTAGLSADPETFAKNRELEVIHSRWAMLGALGCVFPELLAKTGVKFGEAVWFKAGAQIFSEGGLDYLGNPNLIHAQSILAIWASQVVLMGLIEGYRVGEDPLGGLDPLYPGGAFDPLGLADDPEAFAELKVKEIKNGRLAMFSMFGFFVQAIVTGKGPIENLYDHLADPTANNAWAYATNFVPGK

SEQ ID NO: 7893 - protein, 201 aa, Cicer arietinum
MATSAIQQSAFTGKTGLRQGNEFIRKAGSFGQGRFTMRRTVKSTPESIWYGPDRPKYLGPFSEQIPSYLTGEFPGDYGWDTAGLSADPETFARNRELEVIHSRWAMLGALGCTFPEILEKNGVKFGEAVWFKAGAQIFSEGGLDYLGNPNLIHAQSILAIWATQVVLMGFVEGYRVGGGPLGEGLDPLYPGGAFDPLGLAD

SEQ ID NO: 7894 - protein, 62 aa, Artemisia annua
MATSAIQQSAFVGESAVKPQNELVKKIGSFNGGRFTMRRTVKSAPQSIWYGPDRPNPIILDW

SEQ ID NO: 7895 - protein, 152 aa, Cedrus atlantica
MMATASAIQSSSLAGQTLLRPQQNELVKKVGMSQARITMRRTVRSAPESIWYGPDRPKFLGPFSEQTPSYLTGEFPGDYGWDTAGLSADPETFAKNRELEVIHCRWAMLGALGCVFPELLAKTVFNLVKPCGSRPVRRYSRREASTTWVTPT

SEQ ID NO: 7896 - protein, 265 aa, Adiantum capillus-veneris
MTSASAISSSTFAGQTALKSQSELSKRVGNVDARVTMRRTVKSTPESIWYGPDRPKYLGPFSEATPSYLTGEFPGDYGWDTAGLSADPETFSKNRELEVIHARWAMLGALGCVTPELLAKNGVKFGEAVWFKAGSQIFADGGLDYLGNPSLVHAQSILAIWACQVVLMGAVEGYRVGGGPLGEGLDPVYPGGAFDPLGLADDPDSFAELKVKEIKNGRLAMFSMFGFFVQAIVTGKGPIENLSDHLADPTVNNAWAYATNFTPGK

SEQ ID NO: 7897 - protein, 237 aa, Pinus taeda
MATASAIQSSSLAGQTLLRPQQNELVKKVGTSQARITMRRTVRSAPESIWYGPDRPKYLGPFSEQTPSYLTGEFPGDYGWDTAGLSADPETFAKNRELEVIHCRWAMLGALGCVFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVRDREGPH

SEQ ID NO: 7898 - protein, 265 aa, Pteridium aquilinum
MTSASSLSSSTFAGQTVLKSQSELSKRVGNVDARVTMRRTVKSTPESIWYGPDRPKFLGPFSEATPSYLTGEFPGDYGWDTAGLSADPETFAKNRELEVIHSRWAMLGALGCVTPELLAKNGVKFGEAVWFKAGSQIFADGGLDYLGNPNLVHAQSILAIWACQVVLMGAVEGYRVGGGPLGEGLDPVYPGGAFDPLGLAEDPDSFAELKVKEIKNGRLAMFSMFGFFVQAIVTGKGPIENLSDHLADPAVNNAWAYATNFTPGK

SEQ ID NO: 7899 - protein, 227 aa, Cenchrus ciliaris
MAASALHQTTSFLGQALVSRPAAADAGGRITMRRTVKSAPQSIWYGPDRPKYLGPFSEQTPSYLTGEFPGDYGWDTAGLSADPETFARNRELEVIHSRWAMLGALGCVFPEILAKNGVKFGEAVWFKAGAQIFSEGGLDYLGNPNLVHAQSILAIWACQVVLMGFVEGYRVGGGPLGEGLDKVYPGGAFDPLGLADDPDTAAELKVKELKNGRLAMFSMFGFFVQAI

SEQ ID NO: 7900 - protein, 264 aa, Pteridium aquilinum
MTSAALSSSTFAGQTALKSQSELSKRVGNVEARVSMRRTVKSTPESIWYGADRPKFLGPFSEATPSYLTGEFPGDYGWDTAGLSADPETFAKNRELEVIHARWAMLGALGCVTPELLAKNGVKFGEAVWFKAGSQIFAEGGLDYLGNPNLVHAQSILAIWACQVVLMGAVEGYRVGGGPLGDGLDPIYPGGAFDPLGLAEDPDSFAELKVKEIKNGRLAMFSMFGFFVQAIVTGKGPIENLSDHLADPAVNNAWAYATNFTPGK

SEQ ID NO: 7901 - protein, 123 aa, Euphorbia peplus
GNLGGARVVMRRTVKSAPESIWYGPDRPKYLGPFSEQTPSYLTGEFPGDYGWDTAGLSADPETFAKNRELEVIHCRWAIASGLSAVSFPELLSKNGVTFGEAVWLQSRISNLFRRWSRLPWKP

SEQ ID NO: 7902 - protein, 77 aa, Euphorbia peplus
MRRALGCVFPELLSKNGVTFGKQSGSKAGSQIFSEGGLDYLGNPNLIHAQSILAIWACQVVLMGFVEGYRIGGGPFG

SEQ ID NO: 7903 - protein, 231 aa, Artemisia annua
FTMRRTVKSAPQSIWYGPDRPKYLGPFSEQTPSYLTGEFPGDYGWDTAGLSADPETFAKNRELEVIHSRWAMLGALGCVFPELLSKNGVKFGEAVWFKAGSQIFSEGGLDYLGNPNLIHAQSILAIWASQVVLMGLIEGYRVGGGPLGEGLDSIYPGGSFDPLGLADDPEAFAELKVKELKNGRLAMFSMFGFFVQAIVTGKGPIENLSDHLSDPVANNAWAYATNFVPGK

SEQ ID NO: 7904 - protein, 98 aa, Zostera marina
MGFIEGYRVGGGPLGDGLDPLYPGGSFDPLGLADDPEAFTELKVKEVKNGRLAMFSMFGYFVQAIVTGKGPIENLYDHLADPVANNAWAFATNFSPAN

SEQ ID NO: 7905 - protein, 208 aa, Brassica napus
MATSAIQQSSFAGQTALKPSNDLLRKVGVSGGGRVTMRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWACQVVLMGLIEGYRIGGGPVGEGLRPVFTRGGAFDPLNRGGGPRGLR

SEQ ID NO: 7906 - protein, 98 aa, Cicer arietinum
MATSAIQQSAFTGKTGLRQGNEFIRKAGSFGQGRFTMRRTVKSTPESIWYGPDRPKYLGPFSEQIPSYLTGEFPGDYGWDTAGLSADPETFARTVSWK

SEQ ID NO: 7907 - protein, 232 aa, Cynara scolymus
  misc_feature (211)..(211): Xaa can be any naturally occurring amino acid
  misc_feature (230)..(230): Xaa can be any naturally occurring amino acid
MATSAIQHSAFAGQPALKPQNDLIKKTGTFTGGRFTMRRTVKSTPQSIWYGPDRPKYLGPFSEQTPSYLTGEFPGDYGWDTAGLSADPETFAKNRELEVIHSRWAMLGALGCVFPELLSKNGVKFGEAVWFKAGSQIFSEGGLDYLGNPNLVHAQSILAIWASQVVLMGLIEGYRVGGGPLGEGLDKIYPGGAFDPLGLADDPEAFAELKXKELKNGRLAMFSCSDSSFXPL

SEQ ID NO: 7908 - protein, 165 aa, Zostera marina
MATSAIHQSVFVGQTTLKQQNELVRKVGVFESRISMRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVV

SEQ ID NO: 7909 - protein, 269 aa, Cryptomeria japonica
MAAFQMSSLGSFAGQPLNQPRNEFARQMGIAIGNFESRVNMRRTIKSVPQSLWYGPDRPKYLGPFSEQTPSYLTGEFPGDYGWDTAGLSADPETFAKNRELEVIHCRWAMLGALGCVFPEILSKTGVKFGEAVWFKAGSQIFSEGGLDYLGNPNLIHAQSILAIWASQVVLMGLIEGYRVGGGPLGEGLDPLYPGGAFDPLGLADDPEAFAELKVKEIKNGRLAMFSMFGFYVQAIVTGKGPIENLYDHLADPSTNNAWAYATNFVPGK

SEQ ID NO: 7910 - protein, 225 aa, Flaveria ramosissima
QSRVHHKAYGSGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELKVKELKNGRLAMFSMFGFFVQAIVTGKARSRTCLIMSAIRWLTTLGLMPPTLFLE

SEQ ID NO: 7911 - protein, 229 aa, Raphanus sativus
MRRTVKSTPQSIWYGPDRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWASQVVLMGLIEGYRIGGGPLGEGLDPLYPGGAFDPLNLAEDPEAFSELKVKELKNGRLAMFSMFGFFVQAIVTGKGPIENLFDHVADPVANNAWAYATNFVPGK

SEQ ID NO: 7912 - protein, 257 aa, Cicer arietinum
MATSAIQQSAFTGKTGLRQGNEFIRKAGSFGQGRFTMRRTVKSTPESIWYGPDRPKYLGPFSEQIPSYLTGEFPGDYGWDTAGLSADPETFARNRELEVIHSRWAMLGALGCTFPEILEKNGVKFGEAVWFKAGAQIFSEGVLTHAQSILAIWATQVVLMGFVEGYRVGGGPLGEGLDPLYPGGAFDPLGLADDPDAFAELKVKEIKNGRLAMTSMFGFFVQAIVTGKGPIQNLYDHVADPVANNAWAFATNFVPGQ

SEQ ID NO: 7913 - protein, 70 aa, Zostera marina
MATPAIHQSVFVGQTTLKQQNELVRKVGVFESRISMRRTVKSTPDSVWYGADRPKYLGPFSEQTPSYLTW

SEQ ID NO: 7914 - protein, 229 aa, Zostera marina
MRRTVKSTPDSVWYGADRPKYLGPFSEQTPSYLTGEFPGDYGWDTAGLSADPETFAKNRELEVIHCRWAMLGALGCVFPELLSKNGVKFGEAVWFKAGSQIFSDGGLDYLGNPNLVHAQSILAIWACQVVLMGFIEGYRVGGGPLGDGLDPLYPGGSFDPLGLADDPEAFTELKVKEVKNGRLAMFSMFGYFVQAIVTGKGPIENLYDHLADPVANNAWAFATNFSPAN

SEQ ID NO: 7915 - protein, 229 aa, Phalaenopsis aphrodite
MRRTVKSVPQSIWYGPDRPKYLGPFSEQTPSYLTGEFPGDYGWDTAGLSADPETFAKNRELEVIHSRWAMLGALGCVFPELLSRNGVKFGEAVWFKAGAQIFSEGGLDYLGNPNLIHAQSILAIWASQVILMGFVEAYRVGGGPLGEGLDKIYPGGAFDPLGLADDPEAFAELKVKELKNGRLAMFSMFGFFVQAIVTGKGPIENLYDHLADPTTNNAWAYATNFVPGK

SEQ ID NO: 7916 - protein, 253 aa, Picea glauca
GQTLLRPHQNELVKKVGASQARITMRRTVRSAPESIWYGPDRPKYLGPFSEQTPSYLTGEFPGDYGWDTAGLSADPETFAKNRELEVIHCRWAMLGALGCVFPELLAKTGVKFGEAVWFKAGAQIFSEGGLDYLGNPNLIHAQSILAIWASQVVLMGLIEGYRVGGGPLGEGLDPLYPGGAFDPLGLADDPEAFAELKVKEIKNGGLAMFSMFGFFVQAIVTGKGPIENFFDHLADPTANNAWAYAPNFVPGK

SEQ ID NO: 7917 - protein, 226 aa, Unknown
  Sequence found in Organisms: Euphorbia peplus, Euphorbia esula
TVKSAPQSIWYGPDRPKYLGPFSEQTPSYLTGEFPGDYGWDTAGLSADPETFAKNRELEVIHSRWAMLGALGCVFPELLAKNGVQFGESVWFKAGSQIFSEGGLDYLGNPNLIHAQSILAIWAVQVVLMGFVEGYRVGGGPLGEGLDPIYPGGAFDPLGLADDPDAFAELKVKELKNGRLAMFSMFGFFVQAIVTGKGPIENLFDHVADPVANNAWAYATNFVPGK

SEQ ID NO: 7918 - protein, 227 aa, Tropaeolum majus
RTVRSVPQSIWYGPDRPKYLGPFSEQTPSYLTGEFPGDYGWDTAGLSADPETFSKNRELEVIHSRWAMLGALGCVFPEILSKNGVKFGEAVWFKAGSQIFSEGGLDYLGNPNLVHAQSILAIWASQVVLMGFIEGYRIGGGPLGEGLDPLYPGGAFDPLGLADDPESFAELKVKELKNGRLAMFSMFGFFVQAIVTGKGPVENLFDHLADPATNNAWAYATNFVPGK

SEQ ID NO: 7919 - protein, 123 aa, Cicer arietinum
MATSAIQQSAFTGKTGLRQGNEFIRKAGSFGQGRFTMRRTVKSTPESIWYGPDRPKYLGPFSEQIPSYLTGEFPGDYGWDTAGLSADPETFARNRELEVIHSRWAMLGALGCTFPEILRKEWC

SEQ ID NO: 7920 - protein, 242 aa, Flaveria ramosissima
MATSAIQQSAFAGSAALKPQNELVKKTGSFNGGRFTMRRTVKSAPQSIWYGPDRPKYLGPFSEQTPSYLTGEFPGDYGWDTAGLSADPETFAKNRELEVIHSRWAMLGALGCVFPEILAKNGVKFGEAVWFKAGSQIFSEGGLDYLGNPNLIHAQSILAIWACQVVLMGLIEGYRVGGGPLGEGLDKIYPGGSFDPLGLADDPDAFAELRLRSLRTDDWLCFDVRVLRSGHRYWKGPIENLF

SEQ ID NO: 7921 - protein, 189 aa, Fragaria vesca
MATSQIQQSAFAGQTALKQSNELIKKIGGLGGGPITMRRTVKSAPESIWYGPDRPKYLGPFSEQTPSYLTGEFPGDYGWDTAGLSADPETFAKNRELEVHWAASFQKSCPKTVSSSVRLFGSRPGPKSFPRAAWTTSATQTLSTPTASWQSGPSRLSSWASLRGTESVEAPLVRVWIHFTQEDHLTHLD

SEQ ID NO: 7922 - protein, 90 aa, Zostera marina
MVLTHFYPGGSFDPLGLADDPEAFTELKVKEVKNGRLAMFSMFGYFVQAIVTGKGPIENLYDHLADPVANNAWAFATTSPRQTKYNNLHI

SEQ ID NO: 7923 - protein, 558 aa, Hordeum vulgare
MRAAVFVLGIQAFEIMAIAAVGNNLITYVFGEMHFPLSEAANVVTNFVGTIFLLSLLGGFLSDSYLGCFWTMLTFGFVELSGFILLSVQAHLPQLKPPPCSMASMDGSCEQARGFKSSIFFVALYLVALGSGCLKANMIAHGGDQFSGGADNAKSLSTYFNSAYFSFCLGELVALTALVWVQTHSGMDVGFGISAAAMAAGLISLVSGAAFYRNKPPQGSIFTPIARVFVAAFTKRKQICPTNPSNAGIGEPARLAGSFRHGNKFRFLDKACVRDAAQQQQQQQQGGNTKPESPWRLCTVSEVQQAKTLLAVTPIFACTIVFNTVLAQLQTFSVQQGTAMDTVLGGTFRVPPASLQAIPYAMLLVLVPAYELLLVPSMKRLTGTRSGITPLQRIGVGLGTVAFSMVAAATVERRRRDLAASGTQMHVLWIVPQFLVFGVSEMFTAVGLIEFFYKQACAGMQSFLTALTYCSYAFGFYLSSVLVTTVNRVTARHGGAGWLGDNDLNKDRLDLFYWMLAVLSVLNFFCYLLCARWYNSGADGSDAASAQIAAEGDAKEIS

SEQ ID NO: 7924 - protein, 593 aa, Setaria italica
MDVESRAGAPEAAAVAVDWRGRPCRPHRHGGMRAAVFVLGIQGFEIMAIAAVGNNLITYVFGEMHFPLSQAANVVTNFVGTIFLLSLLGGFLSDSYLGCFWTMLTFGFVELSGFILLSLQAHLPQLKPPPCNMASMDGSCEKASGFKSTVFFLALYLVALGSGCLKPNMIAHGADQFDTAAPGGAGRLSTYFNSAYFSFCAGELVALTALVWVQTHSGMDVGFGISAAAMAAGLVSLVSGAALYRNKPPQGSIFTPIARVFVAAYSKRKQVCPSSSNSVNAGACEPARAAAGNFRHGNKFRFLDKACIRVAPQGPNTKPESPWRLCTVAEVQQAKTLLAVTPIFACTIVFNTVLAQLQTFSVQQGSAMDTTLPPGSSFRIPPASLQAIPYAMLLALVPAYELLLVPLMKRATGTRSGITPLQRIGVGLGTVAFSMVAAAAVERRRRDAATAGGHQMSVLWIVPQFLVFGVSEMFTAVGLIEFFYKQACAGGMQAFLTALTYCSYAFGFYLSSLLVSLVNRVTARQGGGGGWLGDNDLNKDRLDLFYWMLAALSVLNFFCFLLCARWYNAGVDGSDAAASGQVAAEGADGKEII

SEQ ID NO: 7925 - protein, 611 aa, Oryza sativa
MDVESCASSSPPPDAAVDWRGRPCEPRRHGGMRAAVFVLGIQAFEIMAIAAVGNNLITYVFGEMHFPLSQAANVVTNFVGTIFLLSLLGGFLSDSYLGCFWTMLIFGFVELSGFILLSVQAHLPQLKPPPCNMAATDGGCEQARGIKASIFFAALYLVALGSGCLKPNMIAHGADQFAAAAGGGGAAAADNAKRLSTYFNSAYFSFCAGELVALTALVWVQTHSGMDVGFGISAAAMAAGLVSLVSGAAFYRNKPPQGSIFTPIARVFVAAYTKRKQICPSSSSDPVNAGVCEPAHLAGGSFRHASKFRFLDKACIRAAEQGPNTKPESPWRLCTAAEVRQAKTLLAVAPIFACTIVFNTVLAQLQTFSVQQGSAMDTALGGAGSSFRIPPASLQAIPYAMLLALVPAYELLLVPLMRRATGARSGITPLQRIGVGLCTVPLSMVAAATVEHRRRDLSLSAGGAPPRAMSVLWIVPQFLVFGVSEMFTAVGLIEFFYKQARGAGMQSFLTALTYCSYAFGFYLSSVLVSLVNRVTASRGGGGHGGWLGDNDLDKDRLDLFYWMLAVLSVINFFCYLLCARWYNSGGADDGCDASASAQVAAEGDGNGKEII

SEQ ID NO: 7926 - protein, 544 aa, Secale cereale
AFEIMAIAAVGNNLITYVFGEMHFPLSEAANVVTNFVGTIFLLSLLGGFLSDSYLGCFWTMLTFGFVELSGFILLSVQAHLPQLKPPPCNMASMDGSCEQARGFKSSIFFVALYLVALGSGCLKPNMIAHGGDQFSGSGGADNAKSLSTYFNSAYFSFCLGELVALTALVWVQTHSGMDVGFGISAAAMAAGLISLVSGAAFYRNKPPQGSIFTPIARVFVASFSKRKQICPTNPGNAGIGEPARLAGSFRHGNKFRFLDKACVRDAAQQQGANTKPESPWRLCTVSEVQQAKTLLAVTPIFACTIVFNTVLAQLQTFSVQQGSAMDTVLGGAFRVPPASLQAIPYAMLLLLVPAYELLLVPFMKRLTGTRSGITPLQRIGVGLGTVAFSMVAAATVERRRRDLSASGAQMSVLWIVPQFLVFGVSEMFTAVGLIEFFYKQACAGMQSFLTALTYCSYAFGFYLSSVLVTTVNRVTARHGGAGWLGDNDLNKDRLDLFYWMLAALSVLNFFCYLICARWYNSGADGSDAASAQIAAEGDAKEIS

SEQ ID NO: 7927 - protein, 589 aa, Sorghum bicolor
MDVEMSCAAAVSVDWRGRPCRPRRHGGMRAAVFVLGIQALEIMSIAAVGNNLITYVFGEMHFPLSQAANVVTNFVGTIFLLALLGGFLSDSYLGCFWTMLIFGFVELSGFILLSLQAHLPQLKPPPCNMASSTDVGGGGCEKASGFKSTVLFLALYLVALGSGCLKPNMIAHGADQFDGGAARRLPTYFNAAYFSFCAGELVALTALVWVQTHSGMDVGFGISAVAMAAGLVCLVSGAAFYRNKPPQGSIFTPIARVFVAAFTKRKQVCPSNSNSVNAGACEPARLAGNFRHSNKFRFLDKACIPVAPQGPNTKPESAWRLCTAAQVQQAKTLLAVTPIFACTIIFNTVLAQLQTFSVQQGSAMDTALPPGSGSFRIPPASLQAIPYAMLLALVPAYELLLVPLMKRVTGTRSGITPLQRIGVGLGTVAFSMVAAADVERRRRVAAAEGRQMSVLWIVPQFLVFGVSEMFTAVGLIEFFYKQACAAGMQAFLTALTYCSYAFGFYLSSVLVSLVNRVTARHGGGGWLGDNDLNKDRLDLFYWMLAALSVLNFFVYLLCARWYNAGADGCDAPASAGQVASEVDDGKEII

SEQ ID NO: 7928 - protein, 592 aa, Panicum virgatum
MDVESRAAEPEAAVGAVDWRGRPCRAHRHGGMRAAVFVLGIQAFEIMAIAAVGNNLITYVFGEMHFPLPQAANVVTNFVGTIFLLALLGGFLSDSYLGCFWTILTFGFVELSGFILLSLQAHLPQLKPPPCSMAASTGGGCEKARGFKATVFFLALYLVALGSGCLKPNMIAHGADQFDAAAPGGAGRLSTYFNSAYFSFCAGELVALTALVWVQTHSGMDVGFGISAAAMAAGLVSLVSGAALYRNKPPQGSIFTPIARVFVAAYSKRKQVCPSSSNSVNAGACEPSHLAGNFRHGNKFRFLDKACIRVAPQGPNTKPESPWRLCTVAEVQQAKTLLAVTPIFACTIVFNTVLAQLQTFSVQQGSAMDTSFPPGSSFRIPPASLQGIPYAMLLALVPAYELLLVPLMKRVTGTRSGITPLQRIGVGLGTVAFSMVAAADVERRRRDAAARGHRMSVLWIAPQFLVFGVSEMFTAVGLIEFFYKQACAGMQAFLTALTYCSYAFGFYLSSVLVSLANRVTARHGGGGGWLGDNDLNKDRLDLFYWMLAALSVLNFFCFLLCARWYNAGVDGSDAAAASGQVAAEGVDGKEII

SEQ ID NO: 7929 - protein, 592 aa, Panicum virgatum
MDVESRAAAPEAEDVAVDWRGQPCRAHRHGGMRAAIFVLGIQAFEIMAIAAVGNNLITYVFGEMHFPLPQAANVVTNFVGTIFLLALLGGVLSDSYLGCFWTILTFGFVELSGFILLSLQAHLPQLKPPPCSMVASAGGGCEKARGFKATVFFLALYLVALGSGCLKPNMIAHGADQFDAAAPGGAGRLSTYFNSAYFSFCAGELVALTALVWVQTHSGMDVGFGISAAAMAAGLLSLVSGAALYRNKPPRGSIFTPIARVFVAAYSKRKQVCPSRSNSVNAGGACEPARLAGNFRHNNKFRFLDKACIRVAQQGPNTKPESPWRLCTVAEVQQAKTLLAVTPIFACTIVFNTVLAQLQTFSVQQGSAMDTSLLPGSSFHIPPASLQGIPYAMMLALVPAYELLLVPLMKRATGTRSGITPLQRIGVGLGTVAFSMVAAADVERRRRGAAAGGHRMSVLWIVPQFLVFGVSEMFTAVGLIEFFYTQACAGMQAFLTALTYCSYAFGFYLSSVLVSLVNRVTARHGVGGWLGDNDLNKDRLDLFYWMLAALSVLNFFCFLLCARWYNAGVDGSDAAAASGQVAAEGVDGKEII

SEQ ID NO: 7930 - protein, 339 aa, Zea mays
MDVEMSCAAPEAAAVPVDWRGRPCRPRRHGGMRAAVFVLGVQAFEIMAIAAVGNNLITYVFGEMHFPLSQAANVVTNFVGTIFLLALLGGFLSDSYLGCFWTMLIFGFVELSGFILLSLQAHLPQLKPAPCDMSSTDGGCEKASGFKSTVFFLALYLVALGSGCLKPNMIAHGADQFDAATPGGANSLPTYFNSAYFSFCAGELVALTALVWVQTHSGMDVGFGVSAVAMAAGLASLVAGAAFYRNKPPQGSIFAPVARVFVAAFTKRKQVCPSSSNSVNAGACEPARLAGNFRHNNKFRFLDKACVPAAPQGPNTKPGEARGGCARWPRCSRQRRSSP

SEQ ID NO: 7931 - protein, 286 aa, Setaria italica
MLHEQQAPAVAAAAAAAPPPVPSAPSSSHDEDGDGGEGAATTFRDIHPLTPDPPTPLPPARTGSAASWDTASHRSYSSEEQYMTMSREFTAMVAAGATMQTGPNANSGGGYDNGAADQLTSIGEDELEETNPLAIVPDSHPIATPARSRASGLEVVPAGPPPPPPAHVEASQVKKEEVETKVSAWQTAEVAKINNRFKREEVVINGWETEQVEKASAWLKKIERKLDEQRAKALEKTQNDIAKARRKAEEKRASAEAKRGLKLAKVLELANFMKAVGRVPTKRSFF

SEQ ID NO: 7932 - protein, 280 aa, Panicum virgatum
MLHEQQAPAVAAAAPPPVPSAPSNDGGDAAGGDESAATFRDIHPLTPDVPTPPARTTSAASWDTASHRSYSSDEQYMTMSREFTAMVAAGATMQTGPNANGSAGGGYDNGADQLTSIGEDELEETNPLAIVPDSHPIATPARSRASGLEVVPAGPPPQPAHVEASQVKKEEVETKVTAWQTAEVAKINNRFKREEVVINGWETEQVEKASAWLKKIERKLDEQRAKAVEKTQNDIAKARRKAEEKRASAEAKRGLKLAKVLELANFMKAVGRVPTKRSFF

SEQ ID NO: 7933 - protein, 281 aa, Panicum virgatum
MLHEQRAPAVAAAAAPPPVPSAPSNDGGDAAGGDEGAATFRDIHPLTPDVPTPPARTASASWDTASHRSYSSEEQYMTMSREFTAMVAAGATMQTGPNSNGSAGGGGYDNGVDQLTSIGEDELEETNPLAIVPDSHPIATPARSRASGLEVVPAGPPPPPAHVEASQVKKEEVETKVTAWQTAEVAKINNRFKREEVVINGWETEQVEKASGWLKKIERKLDEQRAKAVEKTQNDIAKARRKAEEKRASAEAKRGLKLAKVLELANFMKAVGRVPTKRSFF

SEQ ID NO: 7934 - protein, 281 aa, Panicum virgatum
MLHEQRAPAVAAAAAPPPVPSAPSNDGGDAAGGDEGAATFRDIHPLTPDVPTPPARTASASWDTASHRSYSTEEQYMTMSREFTAMVAAGATMQTGPNSNGSAGGGGYDNGVDQLTSIGEDELEETNPLAIVPDSHPIATPARSRASGLEVVPAGPPPPPAHVEASQVKKEEVETKVTAWQTAEVAKINNRFKREEVVINGWETEQVEKASGWLKKIERKLDEQRAKAVEKTQNDIAKARRKAEEKRASAEAKRGLKLAKVLELANFMKAVGRVPTKRSFF

SEQ ID NO: 7935 - protein, 130 aa, Panicum virgatum
MLHEQQAPAVAAAAPPPVPSAPSNDGGDAAGGDEGAATFRDIHPLTPDVPTPPARTTSAASWDTASHRSYSSDEQYMTMSREFTAMVAAGATMQTGPNANGSAGRPATTTAPTSSPASARTSWRRPTHWP

SEQ ID NO: 7936 - protein, 294 aa, Pennisetum glaucum
MLHEQQAPAVAAAAEAAAPPPVPSAPSSSHDEDGGDGGGVELAATTFRDIHPLTPDPPTPRPPPPVRTGSAASWDTASHRSYSSSDEQYMTMSREFTAMVAAGATMQTGPNASGGGGYDNGSADHLTSIGEDELEETNPLAIVPDSHPIATPARSRASGLEVVPAGPAPPQPPAHVEASQVKKEEVETKVTAWQTAEVAKINNRFKREEVVINGWETEQVEKASAWLKKIERKLDEQRAKALEKTQNDIAKARRKAEEKRASAEAKRGLKLAKVLELANFMKAVGRVPTKRSFF

SEQ ID NO: 7937 - protein, 298 aa, Solanum phureja
MDSMNSYWQFGDELRGQSKVSEDHTWTAGAVKLAEQLRSKGERRNNLDLSKGSAESRSRDYLGLQEDNKWGNLYFNMLNIDTKITDNTTKSSFRNDIYNINSVCPKSNVNSLGNTSFSKFNSNHTNDTCNYGNNNNTESINGNNAVDKRFKTLPAAETLPRNEVLGGYIFVCNNDTMQEDLKRQLFGLPPRYKDSVRAITPGLPLFLYNYTTHQLHGIFEAASFGGSNIDPTAWEDKKCRGESRFPAQVRIRVRKLGKALEEDAFRPVLHHYDGPKFRLELSVPETLDLLDLCENTSA

SEQ ID NO: 7938 - protein, 298 aa, Solanum melongena
MEKMNSYWQFGDELRGQSKVPEDHTWTTAATKLAEQIWSKGERKNNLDLSKGSAENRSRDYLGLQEDNKWENLNFNMLNFDTKITENMTKSSIRNGIYNINSVCPKPNVNSLGNMSLSKFSSNQMNVPCDYGNNNNTESTNGNNAVDKRFKTLPAAEILPRNEVLGGYIFVCNNDTMQEDLKRQLFGLPPRYKDSVRAITPGLPLFLYNYTTHQLHGIFEAASFGGSNIDPTAWEDKKCKGESRFPAQVRSRVRKLGKPLEEDAFRPVLHHYDGPKFRLELSVPETLDLLDLCEKASA

SEQ ID NO: 7939 - protein, 256 aa, Triticum aestivum
RPAMSHSSAFLLPSSATPAASADAYAVVVLNQRLPRFAPLLWDRAQVRVCADGGANRVFDGMPELLPGHDRDDVRSRYKPDVIKGDMDSVRPEVKEYYSNLGTKIADQSHDQDTTDLHKCVAFITDNSPGSDKSNLCILVLGALGGRFDHEMGNINVLHLFPNIKIVLLSDDCLIFLLPRTHTHNIHIERSVEGPHCGLIPVGAPSTSTTTTGLRWNLDNTHMSFGGLISTSNIVDEDQVMVTSDSDLIWTISLRH

SEQ ID NO: 7940 - protein, 265 aa, Secale cereale
MDPPSPATARPAMSHSSAFLLPSSATPAGSADAYAVVVLNQRLPRFAPLLWDRAQVRVCADGGANRVFDGMPELLPGHAPDDVRSRYKPDVIKGDMDSVRPEVKEFYSNLGTNIVDQSHDQETTDLHKCVAFITDNSPGPDKSNLCILVLGALGGRFDHEMGNINVLHLFPNIKIVLLSDDCLIFLLPRTHTHNIHIERSVEGPHCGLIPIGAPSTSTTTTGLRWNLDNTHMSFGELISTSNIVDEDRVMVTSDSDLIWTISLRH

SEQ ID NO: 7941 - protein, 276 aa, Setaria italica
MALAPTPPPPAPQRPTMRHSSAFLLPLPSSSSSPAPGGGPADASVALVVLNQPLPRFAPLLWSRAAVRVCADGGANRVFDGMPELLPGQDAVEVRERYKPDVIKGDMDSVRPEVKEYYSNLGTKIVDESHDQDTTDLHKCIAFIAKNSPVAGKSNICILVLGALGGRFDHEMGNINVLHLFPNINIVLLSDDCLIFLLPRTHSHEIHIERSIEGPHCGLIPIGMPSTSTTTTGLRWNLDNNSMSYGGLISTSNIVEEDKVTVTSDSDLIWTISLQK

SEQ ID NO: 7942 - protein, 267 aa, Oryza sativa
MAPRPAMSHSSAFLLPSPSAAAAGADADGAAYALLVLNQRLPRFAPRLWDRAQVRVCADGGANRVFDGMPELFPGQDPDEVRRRYKPDVIKGDLDSVRPEVKEYYSNMGTQIVDESHDQDTTDLHKCVAFITENSAIPNKSNLCIFALGALGGRFDHEMGNINVLHLFPNNRIILLSDDCLIFLLPRTHTHNIHIERSIEGPHCGLIPIGAPSATTTTTGLQWNLDNTSMSFGGLISTSNIVREESTVVTITSDSDLIWTISLRHHS

SEQ ID NO: 7943 - protein, 260 aa, Panicum virgatum
MPLPAMTHSSAFLLPASTTPPPNDAATTYALVVLNQRLPRFAPLLWARARLRVCADGGANRVFDGMPELLPGEDPADVRARYKPDVIKGDMDSIRPEVKEYYSNLGTNIVDESHDQDTTDLHKCVSFVTRELPVPDKSNLCILVLGALGGRFDHEMGNINVLYRFSNTKIVLLSDDCSIFLLPKTHTHEIHIEKSVEGPHCGLIPIGGPSTSTTTTGLRWNLDNTSMSYGGLVSTSNIVDDDKITVTSDSDLIWTISLRN

SEQ ID NO: 7944 - protein, 175 aa, Panicum virgatum
MPLPAMTHSSAFLLPASTTPPPNDAATTYALVVLNQRLPRFAPLLWARARLRVCADGGANRVFDGMPELLPVEDPADVRARYKPDVIKGDMDSIRPEVKEYYSNLGTNIVDESHDQDTTDLHKCVSFVTRELPVPDKSNLCILVLGALGGRFDHEMGEYQCIIPFLKHQNCPPVR

SEQ ID NO: 7945 - protein, 260 aa, Setaria italica
MPLPAMTHSSAFLLPASTPPSNDAATTTYALVVLNQRLPRFAPLIWARARVRVCADGGANRVFDGMPELLPGEDPAEVRSRYKPDVIKGDMDSIRPEVKEYYSNSGTNIVDESHDQDTTDLHKCVSFITRDLPVSDKSNLCILVLGALGGRFDHEMGNINVLYRFSNTKIVLLSDDCSIFLLPKTYTHEIHIEKSVEGPHCGLIPIGGPSTSTTTTGLRWNLDNTSMSYGGLVSTSNIVDDDKVTVTSDSDLIWTISLRH

SEQ ID NO: 7946 - protein, 263 aa, Sorghum bicolor
MPLPTMTHSSAFLLPSSTAPSNPSGGADTTTYALVVLNQRLPRFAPLLWSRARLRVCADGGANRVFDGMPELLPGEDPAEVRTRYKPDVIKGDMDSIRPEVKEYYSNLGTNIVDESHDQDTTDLHKCVSFITSDLPVPEKSNLYILVLGALGGRFDHEMGNINVLYRFSNIKIILLSDDCSIFLLPKTHSHEIHIETSVEGPHCGLIPMGGPSDITTTTGLRWNLDNTSMRYGGLISTSNIVDEDKVTVTSDSDLIWTISLRN

SEQ ID NO: 7947 - protein, 121 aa, Pseudoroegneria spicata
MLLLDSLNTTDPKRLGPDIRGFIHGIYEIEEREESAHFIKNIRLEFPKVPQQNGEECGIYVLYFINCFLQNRKLAEVLQNKTLEEDFSQLFDDGTFDPEELENFRKDVHAFQVERSTETGQ

SEQ ID NO: 7948 - protein, 628 aa, Triticum aestivum
MASIRSWLIKKVPPAMIPSFFLHVKSLPLTSSGKVDYVKLSSLDCALEPCGIEQIKTESGPINPYLQVIKKAFRDALLVDEVSEFDDFFTLGGNSISAAHAAHKLEIDMRLLYIYPTPSKLLHASVVEHSNLVSPTDDPQPKKGLNVSTSIHGLFDPFAANADDSYHGGKARINGKRAHYQIAGSYGDETDGQLNKYPFSPDDRYQVNDFYLDTCLKDRNSVMGSQWILNFCLHKKWSIGRCNRFMHDDEGKLQLEDVCSYVSYNKRGYLQELWNIPLDSCVDASPLLVLNNGMINIFIGSHSHLFLCIDGCNGSVRWSVKLEGRVECSAAITGDFSEVVVGCYKGKIYFHDMLTGKLSWTVQTDGEVKMQLVVDRTRNLIWCGSYDHYLYALNYKDRCCAYKVSCGGSIYGSPAVDMAHDRIYVACTSGLVTAISLEVPSFRIVWQYEARAAIFSSLAIDHQSGNVVCCLVNGLVIALNSHGTVVWKATVGGPIFASACVSSALPSQVLIPSRDGSLYSFDITSGDLLWSYDVGDPITASAFVDEVLASTPSGASERFACICTSSGKVRVLGIRADAEQEKDGYSVQEFAAMDLPGDIFSSPLMVGGRIFVGCRDDRLHCLSITSHP

SEQ ID NO: 7949 - protein, 628 aa, Triticum aestivum
MASIRSWLIKKVPPAMIPSFFLHVKSLPLTSSGKVDYVKLSSLECALEPCGIEQIKSGSGPVNPYLQVIKKAFCDALLVDEVSEFDDFFTLGGNSISAAHAAHKLEIDMRLLYIYPTPSKLLHALVVEHSNLVSPTDEPQPKKGLNVSTSIHGLFDLSAANADDSYHGGKARINGKRAHYQIAESYGDETDGQLNKYPFSPDDRYQVNDLYLDTCLKDRNSVMGSQWILNFCLHKKWTIGRCNRFMHDDEGKLQLEDVCPHVSYNKIGYLKELWNIPLDSCVDASPLLVLNNGMINIFIGSHSHLFLCIDGCNGSVRWSVKLEGRVECSAAITGDFSEVVVGCYKGKIYFHDMLTGKLSWTVQTDGEVKMQPVVDRTRSLIWCGSYDHHLYALNYKDRCCAYKVSCGGSIYGSPAVDMAHDRIYVACTSGLVTAISLEVPSFRIVWQYEAGAAIFSSLAIDHQSGNVVCCLVNGLVIALNSHGTVVWKATVGGPIFAGACVSSALPSQVLIPSRDGSLYSFDITSGDLLWSYDVGDPITASAFVDEVLASTPSGASERFACICTSSGKVRVLGIRADAEQEKDGYSVQEFAAMDLPGDIFSSPLMVGGRIFVGCRDDRLHCLSITSHP

SEQ ID NO: 7950 - protein, 967 aa, Triticum aestivum
GGDELVWPCERERPREFCYVMFTSGSTGRPKGVCGTEKGLLNRFLWMQRRNPLCSDDVLLFKTSVSFVDHLQEFLSAVLTSTTLVIPPIDWRANPTSLANLIKTYRISRMTIVPSLMEMILPTMEKNISCGYNSLKILVFSGEILSLVLWKRVREILPETTVVNLYGTTEVSGDCTFFDCKDLPAILECEEITSVPIGFPIANCEVVLVTHAGMADEGEICVSGACLFNGYLAEFLMSNHTEGSESSTYYKTGDYARRLKAGELVFLGRKDRTVKNYGQRFSLEEVESTLKEHPAVSDAAVTFQSKGSPDYKAYLVFKNKDGIVKDSLQYREVNSSQDIMASIRSWLIKKVPPAMIPSFFLHVKSLPLTSSGKVDYVKLSSLECALEPCGNEQIKSGSGPVNPYLQVIKKAFCDTLLVDEVSEFDDFFTLGGNSISAAHAAHKLEIDMRLLYIYPTPSKLLHALVVEDSNLVSPTDEPQPKKDLNVSTSIHGLFDLSAANADDSYHGGKAQINGKRAHYQIAESYGDETDGQLNKYPFSSDDRYQVNDLYLDTGLKDRNSVIGSQWILNFCLHKKWSIGRCNRFMHDDEGKLQLEDVCLHVSYNKRGYLQELWNIPLDSCVDASPLLVLNNGMINIFIGSHSHLFLCIDGCNGSVRWSVKLEGRVECSAAITGDFSEVVVGCYKGKIYFHDMLTGKLSWTVQTDGEVKMQPVVDRTRNLIWCGSYDHHLYALNYKDRCCAYKVSCGGSIYGSPAVDMAHDRIYVACTSGLVTAISLEVPSFRIVWQYEAGAAIFSSLAIDHQSGNVVCCLVNGLVIALNSHGTVVWKATVGGPIFAGACVSSALPSQVLISSRDGSLYSFDITSGDLLWSYDVGDPITASAFVDEVLASTPSGSSERFACICTSSGKVRVLGIRADAEQEKDGYSLQEFAAMDLPGDIFSSPLMVGGRILVGCRDDRLHCLSITSHP

SEQ ID NO: 7951 - protein, 837 aa, Triticum aestivum
YNSLKILVFSGEILSLVLWKRVREILPETTIINLYGTTEVSGDCTFFDCKDLPGILEREEITSVPIGFPIANCEVFLVTHAGIADEGEICVSGACLFNGYLAEFLSSNHTEGSVSSTYYKTGDYARRLKAGELVFLGRKDRTVKIYGQRFSLEEVESTLKEHPAVSDAALTFQSKGSPDYKAYLVFKNKDGIVKDSLQYREVNSSQDIMASIRSWLIKKVPPAMIPSFFLHVKSLPLTSSGKVDYVKLSSLECASEPCGIAQIKSGSGLVNPYLQVIKKAFCDALLVDEVSEFDDFFTLGGNSISAAHAAHKLEIDMRLLYIYPTPFKLLDALIVDHSNLVSPTDEPQPKKGLDVSTSVHGLFDPIAANADDGYHGGKARINGKRAHYQIAGSYGNETDGQLNKYPFSPDDRCQVNDLYLDTCLKDRNSVIGSQWILNFCLHKKWSIGRCNRFMHDDEGKLQLEDVCSYVSYNKRGYLQELWNIPLDSCVDASPLLVLNNGMINIFIGSHSHLFLCIDGCNGSVRWSVKLEGRVECSAAITGDFSEVVVGCYKGKIYFHDMLTGKLSWTVQTDGEVKMQPVVDRTRNLIWCGSYDHHLYALNYKDRCCAYKVSCGGSIYGSPAVDMAHDRIYVACTSGLVTAISLEVPSFRIVWQYEAGAAIFSSLAIDHQSGNVVCCLVNGLVIALNSHGTVVWKATVGGPIFAGACVSSALPSQVLIPSRDGSLYSFDITSGDLLWSYDVGDPITASAFVDEVLASTPSGASERFACICTSSGKVRVLGIRADAEQEKDGYSVQEFAAMDLPGDIFSSPLMVGGRIFVGCRDDRLHCLSITNPFN

SEQ ID NO: 7952 - protein, 629 aa, Triticum aestivum
MASIRSWLIKKVPPAMIPSFFLHVKSLPLTSSGKVDYVKLSSLECALEPCGNEQIKSGSGPVNPYLQVIKKAFCDTLLVDEVSEFDDFFTLGGNSISAAHAAHKLEIDMRLLYIYPTPSKLLHALVVEDSNLVSPTDEPQPKKDLNVSTSIHGLFDLSAANADDSYHGGKARINGKRAHYQIAESYGDETDGQLNKYPFSPDDRCQVNDLYLDTCLKDRNSVMGSQWILNFCLHKKWTIGRCNRFMHDDEGKLQLEDVCSHVSYNKRGYLQELWNIPLDSCVDASPLLVLNNGMINIFIGSHSHLFLCIDGCNGSVRWSVKLEGRVECSAAITGDFSEVVVGCYKGKIYFHDMLTGKLSWTVQTDGEVKMQPVVDRTRNLIWCGSYDHHLYALNYKDRCCAYKVSCGGSIYGSPAVDMAHDRIYVACTSGLVTAISLEVPSFRIVWQYEAGAAIFSSLAIDHQSGNVVCCLVNGLVITLNSHGTVVWKATVGGPIFAGACVSSALPSQVLISSRDGSLYSFDITSGDLLWSYDVGDPITASAFVDEVLASTPSGSPERFACICTSSGKVRVLGIRADAEQEKVGYSVQEFAAMDLPGDIFSSPLMVGGRIFVGCRDDRLHCLSITNPFN

SEQ ID NO: 7953 - protein, 412 aa, Triticum aestivum
MDRNSVMGSQWILNFCLHKKWSIGRCNRFMHDDEGKLQLEDVCLHVSYNKRGYLQELWNIPLDSCVDASPLLVLNNGMINIFIGSHSHLFLCIDGCNGSVRWSVKLEGRVECSAAITGDFSEVVVGCYKGKIYFHDMLTGKLSWTVQTDGEVKMQPVVDRTRNLIWCGSYDHHLYALNYQDRCCAYKVSCGGSIYGSPAVDMAHDRIYVACTSGLVTAISLEVPSFRIVWQYEAGAAIFSSLAIDHQSGNVVCCLVNGLVIALNSHGTVVWKATVGGPIFAGACVSCALPSQVLIPSRDGSLYSFDITSGDLLWSYDVGDPITASAFVDEVLASRPSGASERFACICTSSGKVRVLGIRADAEQEKDGYSLQEFAAMDLPGDIFSSPLMVGGRILVGCRDDRLHCLSITSHP

SEQ ID NO: 7954 - protein, 259 aa, Triticum aestivum
MQPVVDRTRNLIWCGSYDHHLYALNYKDRCCAYKVSCGGSIYGSPAVDMAHDRIYVACTSGLVTAISLEVPSFRIVWQYEAGAAIFSSLAIDHQSGNVVCCLVNGLVIALNSNGTVVWKATVGGPIFAGACVSSALPSQVLIPSRDGSLYSFDITSGDLLWSYDVGDPITASAFVDEVLSSTPSGALERFACICTSSGKVRVLGISANAAQEKDGYSVQEFAAMDLPGDIFSSPLMVGGRIFVGCRDDRLHCLSITSQP

SEQ ID NO: 7955 - protein, 263 aa, Secale cereale
MQPVVDRTRNLIWCGSYDHHLYALNYKDRCCAYKVSCGGSIYGSPAVDMAHDRIYVACTSGLVTAISLEVPSFRTVWQYEAGAAIFSSLAIDHQSGNVVCCLVNGLVIALNSHGTVVWKATVGGPIFAGACVSSALPSQVLIPSRDGSLYSFDITSGDLLWSYDVGDPITASAFVDEVLASTPSAASERFACICTSSGKVRVLGIRADTKQGKDGYSVQEFAAMDLPGDIFSSPLMVGGRIFVGCRDDRLHCLSVTNPFNQSE

SEQ ID NO: 7956 - protein, 102 aa, Pseudoroegneria spicata
  misc_feature (1)..(2): Xaa can be any naturally occurring amino acid
XXWSYDVGDPITASAFVDEVLASTPSGASERFACICTSSGKVRVLGIRADAEQEKDGYSVQEFAAMDLPGDIFSSPLMVGGRIFVGCRDDRLHCLSITNPLN

SEQ ID NO: 7957 - protein, 785 aa, Triticum aestivum
MGTLLLAEKVDRHRSSRGKAEVFAWVDSREDDGGGDFFRKNKDILLQQSAGRGKSNIPRPKKCSTKIAPPDKKIIEGCKRRTKSKPCEKTETLPSSDSRLLKSEVKSKKASGKRTKKNLLKDLDDHLSTAKPIKRQLEKVSVDLHDVGQDTQMAIEAIEALAQSSPAENLSAEVEPPVKRDLRVVSKVEKSNPKSDPPRKRTSSVQEGVTTRSKRIKVTEMNHQPQKDMRQNLEDRATKAKHKQAKPVPQKNKVTKIVDGNKYDSTPIAHRTRHTGRNNLYESPELCSNKNLKKATVGEVRNNHSEHVLERPMISERTTEYGSGSVLKENTENTCANNAQGLQQSTDASIRHTSANVAQNLEPLRDEPTTHVFRREPSSHPKQRRTPTAVVQAKAPAVTEAATGHDVTRPSKKRRIFISSSELLTYARRERSDCRSTSLLSSIITQSSAASPVLDSSSGVNSKTSGFSSSDRRQKKSPGVKNASNSPKCNSPVPNSALKTSSKVVNKLSPTFSPLNPSKASNRSLLKSSVAKELLELDPENALPSRYRKDSRRKDMTSCSIIFSHHLDEDVIKRQKKILARLGAHEALSVADATHFVADGFYRTKNMLEAVTRGKLVVTSMWLESCGAAGCFVNDKKYILRDAKKEKEMGFSMPISLASACKSPLLLGKRVFVTQNVKPSREVVTSLVSASSGQPLERMGRSIRKEKEAPDDLLVISCEEDYQTCAPLIEKGVDVFDAELLLNGMVTQKLDYERHRLFLDRVKQTRSTRWLKDGAHGRFVPISKS

SEQ ID NO: 7958 - protein, 569 aa, Triticum aestivum
MNHKPQKDVRQNLEDRATKTKHKQAKPVPQKNKVTKIVDGNKYDSTPIAHRTRHTGRNNLYESPELCSNKNLKKATVGEVRNNHSEHVLERPMISERTAEYGSDSVLKENTENTCANNAQGLQQSTDASIRHTGANVAQNLEPLRDEPTTHVFRREPSSHPKQRRTPTAVVQAKAPAVTEAATGHDVQPEVTRPSKKRRIFISSSELLTYARRERSDCRSTSLLSSIITQSSAASPVLDSSSGVNSKTSRFSTSDRRQKKPPGVKDASNSPKCNSPVPNSALKTPSKVVNKLSPAFSPLNPSKASNRSLLKSSVAKELLELDPENALPSRYRKDSRRKDMTSCSIIFSHHLDEDVIKRQKKILARLGAHEALSVADATHFVADGFYRTKNMLEAVTRGKLVVTSMWLESCGAAGCFVNDKKYILRDAKKEKEMGFSMPISLASACKSPLLLGKRVFVTQNVKPSREVVTSLVSASSGQPLERMGRSIRKEKEAPDDLLVISCEEDYETCAPLVEKGVDVFDAELLLNGIVTQKLDYERHRLFLDRVKQTRSTRWLKDGAHGRFVPVSKS

SEQ ID NO: 7959 - protein, 143 aa, Avena sativa
MTKKRAIGEFRSEERLMLEQALLQEEKQATMELRAEIELREKAGREAKMRMAMAEHARVEAQAHSEMIGQGPLRANAAASQGDDGPSHDMAQEQGEDGWENAERDDDDDPSEDFLNDDNEPENGNSAMQEDWRRSGEFDLNSR

SEQ ID NO: 7960 - protein, 419 aa, Oryza sativa
MDAAANSTPTSSASTVAQNQLHQRQIFLMQQAQAQAQAQGQGHTPTLQQLSQQAMSFFPSNIDAHLPLPGPDSTPTSSASTVAQNQLHQCQIFLMQQAQAQAQAQGQGYTPTPQQLSQQAMSFFPSNIDAHLPLPGPIRFQQPLPQQPPPPQQQIHSWGPSLLQSWASLQQQQQAAVAAVARVQSPEVEMALQDVMQVCNPDIKTPFQSIEDAVNRLLPYHVVADYEAEEDDRILDSDTTGQIPSRLQQWDHNILVKIAEFTTTFEKQVLAYNIMTKKRAIGEFRSEERLMLEQALLMEEKQAMMGLRAEIESREKAGREAAEAKMRMAMAEQARAEAQAHSEMIGHGPLRAHAAASQGEDGPSHEMMQEQGEDGWGNAQRDDEDPSEDFLNDENEPENGNSDMQEDWRRSGELDLNSR

SEQ ID NO: 7961 - protein, 371 aa, Setaria italica
MDDGGNPTPPPSTSTSTAAAAAAAAAQHQQLQRQLFLMQQQAQAQSHPQQLSQQAMSRFPSNIDAHLRPLGPLRFHQPQQQQPQPQPSQPPHSQGPSQSPSQGAPQQASPHHQQHQHQQQQQAAAQAQAQAQAARVRSPEMEMALQDAMRVCNPDIKTPFQSIEDAVNRLLPYHVVADYEAEEDDRILDSDATGQIPSRLQQWDHNILVKIAEFTTTFEKQVLAYNIMTKKRAIGEFRSEERLMLEQALLQEEKQAMLGLRAEMESREKAGREAAEAKMRMAMEHARAEAQAHSEMMNHGPIRGSAVASQGEDGPSRGMEQEHAEDGWGNAQRDDEDPSEDFLNDENEPENGNSDGQEDWRRSGELDLNSR

SEQ ID NO: 7962 - protein, 359 aa, Zea mays
MDDAANPTPPPSTSAASAAAAAAQHQQLQRQLFLMQQAQSHPQQLSQQAMSRFPSNIDAHLRPLGPLRFQQPQPQPQPSHSQGPSQSPSQATQQASPQQQQQQAAAAAAAAQAQAQAQAQAARVRSPEMEMALQDAMRVCNPDVKTPFQSIEDAVNRLLPYHVVADYEAEEDDRILDSDTTGQIPSRLQQWDHNILVKIAEFTTTFDKQVLAYNIMTKKRAIGEFRSEERLMLEQALLQEEKQAMLGLRAEMESREKAGREAAEVKMRLAMEHARAEAQAHSEMMNHGPIRASAVASQGEDGPSHDMVQEHGEDGWGNSQRDDEDPSEDFLNDENEPENGNSDGQEDWRRSGEFDLNSR

SEQ ID NO: 7963 - protein, 301 aa, Saccharum officinarum
MSRFPSNIDAHLRPLGPLRFQQPQQPQPSHSQGPSQSPSQATQQASPQQQQQAAAAAAAQAQAARVRSPEMEMALHDAMRVCNPDVKTPFQSIEDAVNRLLPYHVVADYEAEEDDRILDSDTTGQIPSRLQQWDHNILVKIAEFTTTFDKQVLAYNIMTKKRAIGEFRSEERLMLEQALLQEEKQAMLGLRAEMESREKAGREAAEVKMRMAMEHARAEAQAHSETMNHGPIRASAVASQGDDGPSHDMVQEHGEDEWGNSQRDDEDPSEDFLNDENEPENGNSDGQEDWRRSRELDLNSR

SEQ ID NO: 7964 - protein, 380 aa, Panicum virgatum
MDDGGNPAPPPSTSTSTAAQHQQLQHQLFLMQQHAQAQAQAQVQPHPQQLSQQAMSRFPSNIDAHLRPLGPLRFHQPQQQQKQQPQPQPQPQPPHSQGPSQSPSQGAAQQASPHHHHHQQQQQQAAAAQAQAQAQAQAQAQAARVRSPEMEMALQDAMRVCNPDIKTPFQSIEDAVNRLLPYHVVADYEAEEDDRILDSDTTGQIPSRLQQWDHNILVKIAEFTTTFEKQVLAYNIMTKKRAIGEFRSEERLMLEQALLQEEKQAMLGLRAEMEMREKAGREAAEAKMRMAMEHVRAEAQAHSEMMNHGPIRASAVASQGDDGPTHGMEQEQGDDGWENAQRDDEDPSEDFLNDENEPENGNSDGQENWRRSGELDLNSR

SEQ ID NO: 7965 - protein, 76 aa, Panicum virgatum
MMNHGPIRASAVASQGDDGPTHGIEQEQGDDGWENAQRDDEDPSEDFLNDENEPENGNSDGQENWRRSGELDLNSR

SEQ ID NO: 7966 - protein, 224 aa, Sorghum bicolor
MISSFSIWYFTHTIYSICVKTRLLPYHVVADYEAEEDDRILDSDTTGQIPSRLQQWDHNILVKIAEFTTTFDKQVLAYNIMTKKRAIGEFRSEERLMLEQALLQEEKQAMLGLRAEMESREKAGREAAEVKMRMAMEHARAEAQAHSEMLNHGPIRASVVASQGDNGPSHEMVQEHGEDGWRNSQRDDEEPSEDFLNDENEPENGNSDGHEDWRRSGELDLNSR

SEQ ID NO: 7967 - protein, 261 aa, Pennisetum glaucum
QQQQQQQQAAAAQAQAQAQAQAARVRSPEMEMALQDAMRVCNPDIKTPFQSIEDAVNRLLPYHVVADYEAEEDDRILESDATGQIPSRLQQWDHNILVKIAEFTTTFEKQVLAYNIMTKKRAIGEFRSEERLMLEQALLQEEKHAMLGLRVEMESREKAGREAAEAKMRMAMEHHARAEAQAHSEMMNHGPIRGSAVASQGEDGPSRGMEQEQAEDGWGNAQRDDEDPSEDFLNDENEPDNGNSDGQEDWRRSGELDLNSR

SEQ ID NO: 7968 - protein, 144 aa, Panicum virgatum
MTKKRAIGEFRSEERLMLEQALLQEEKQAMLGLRAEMEMREKAGREASEAKMRMAMEHVRAEAQARSEMMNHGPIRASAVASQGDDGPTHGMEQEQGDDGWENAQREDEDPSEDFLNDENVPENGNSDGQENWRRSGELDLNSR

SEQ ID NO: 7969 - protein, 602 aa, Oryza sativa
MFSLLSRALCAASSSPAAPRGRSLLAALLSPSASPLDPCRGPAAPEPPRRRAFHGSPSPLGFRSTPASWSSPEAGAAVGGDDGLEVARLGISPWIVERLAARGITRLFPIQRAVLDPAMQGKDMIGRARTGTGKTLAFGIPIMDRILRHNEKNGSGRNPLAIILAPTRELARQVEKEFKESAPLDSLCVYGGVPISHQMRALNYGVDVVVGTPGRIIDLLRRGVLNLSEIQFVVLDEADQMLAVGFDEDVEVIMENLPQNRQSMLFSATMPSWIRKITSKYLKDPIIIDLVGDEDQKLPEGISLYSIASEHYGKPSILGPLIKEHANGGKCIVFTQTKREADRLAYAMGRSYACQALHGDISQNQRERTLSGFRDGRFNILVATDVAARGLDIPNVDLVIHYELPNTSELFVHRSGRTARAGKKGSAILIYTNDQARAVRIIEQDIGCKFTELPKIEVADEASDMFNVVRDNRSRLAGSPRTGGSSFGRGGYGGFGEGRSRGFGDFDGFGSSPNRGGRSRDAGSRYGSGFGDFRRPSNAFGRSSSKQPDGFGFGDFGEGNFSRNGNRRSRSFDDSGSTRYSRRPNGFGTSDFGRSGGFDDSN

SEQ ID NO: 7970 - protein, 604 aa, Brachypodium distachyon
MNSLLRRALTASRSAAQPRRTFLGVALLSPPPASSPDSPCRAAVPPPPMRRAFHASPRPLGFRATTPASCPGTVTEAGAGEDGLEVAKLGISPRIVERLAARGITRLFPIQRAVLEPAMQGKDMIGRARTGTGKTLAFGIPIMDRILRHNEKNGTGRNPLAIILAPTRELARQVEKEFKESAPLDTLCVYGGVPINQQMRTLNYGVDVVVGTPGRIIDLLRRGNLNLSEIQFVVLDEADQMLAVGFDEDVEVIMEKLPQNRQSMLFSATMPSWIRKLSNQYLKDPVIIDLVGESDQKLPEGISLYSIASENYGKSSILGTLIKEHANGGKCIVFTQTKREADRLAYSMGRSYACQALHGDITQNQRERTLSGFREGRFNILVATDVAARGLDIPNVDLVVHYEIPNSSELFVHRSGRTARAGKKGIAILMYTYEQSRAVRVIEQDIGCRFTELPKISGTAEAADMFNVSRDPRSRSAGTRTDGSFFGRESYSGFGGRSSRGFGDPDGFGGAPDGAGWSRDTGSRSRGGFGDSRRPSRPLDGSFGRSSFNRSGGFSDFGEGNFGRNDNPDFRRPRSGDDSGSSRFGRSSGGFGASDFGKPGSFKD

SEQ ID NO: 7971 - protein, 619 aa, Triticum aestivum
MNSLLRRALSASSSPARPQRALLSALLSPPPAGSPQPCRPPAPQPLEPPKQRAFHASPRPLGFRSTTPAPWPGTVSEAGAAAGDDGLEVARLGISPRIVERLAARGINRLFPIQRAVLEPAMQGKDMIGRARTGTGKTLAFGIPIMDRILRHNEKNGSGRNPLAIILAPTRELARQVEKEFRESAPLDTLCVYGGVPISQQMRTLNYGVDIVVGTPGRVIDLLRRGVLNLSEIQFVVLDEADQMLAVGFDEAVEVIMEKLPQNRQSMLFSATMPSWIRKLTNQYLKDPVIIDLVGDSEQKLPEGISLYSIVSENYGKSSILGPLIKEHADGGKCIIFTQTKREADRLAYAMGRSYACQALHGDISQNQRERTLSGFRDGRFNILVATDVAARGLDIPNVDLVVHYEIPNSSELFVHRSGRTARAGKKGIAILMYTYEQSRTVKVIEQDIGCRFTELPKVAATDEAADLFNVMRDTRSRSVGTRRSGGSSFSHDGGFGERHSRGFGDFDSFGGTPNRAGWSGDAGSRYRGGFGDSRRPSQPSNGFGRSSGFGDSRRGPQPSDGFGRSSFNRPGGFGEFEEGNSRSGRFPRRSDDSDPSRYGRSSNGFGTSDFGRPGSIKD

SEQ ID NO: 7972 - protein, 444 aa, Panicum virgatum
MQGKDMIGRARTGTGKTLAFGIPIMDRIISYNEKIGSSRNPLAIVLAPTRELARQVEKEFRESAPLDTLCVYGGVPINQQMRVLNYGVDIVVGTPGRIIDLLRRGVLNLSEIQFVVLDEADQMLAVGFDEDVEVIMEQLPQNRQSMLFSATMPSWIRKFSNKYLKDPVIIDLVGDSDQKLPEGISLYSIASDNFGKPSILGPLIKEHAKGGKCIVFTQTKREADRLAYVMGRSYPCQVLHGDISQNQRERTLSGFRDGRFNILVATDVAARGLDIPNVDLVVHYEIPNTSELFVHRSGRTARAGKKGSAILIYTYEQTRAVRVIEQDIGCRFTELPKMPVADEAADMFNVMRDTRSRSVGGRRTGGSFGRESFGGFGDRRSSGFGDFGSNGGSFDRCGGFRDSGLRYRGGSGGFRRPSNEFGRSSFSRSDRFGDFGQGDFSRRG

SEQ ID NO: 7973 - protein, 374 aa, Setaria italica
MRLRQHLASSPIYTSAIARIGNNRAHRLLPVAPPQKHRPTSTTNKLLLLIVLLLFFFFFLRLVPTVLLPPARVMSSSSSASDAAAAVPFEKPRAVVKKLLAESQSEGQGATVRRSIGSHELRNLDPFLMLDEVSVSKPAGFPDHPHRGFETVTYMLEGACIHQDFAGHKGTIRAGDVQWMTAGRGIVHSEMPAGDEVNKGLQLWINLSSKDKMIEPRYQELQSKNISRAEKDGVEVRIIAGEAFGVRSPVYTRTPTMYMDFTMRPGSQLHQPIPEGWNAFVYIVDGEGVFSRDKSAPVSAHHCIVLGAGDGISVWNKSGAPLRFALVAGQPLGEPVVQHGPFVMNSRAEIQQAMEDYYYGKNGFERASQWSSSA

SEQ ID NO: 7974 - protein, 381 aa, Panicum virgatum
MRLRQHLASPIYTSAIARIGNRAHHHRLPIAPPQKLRPSTASTTHNKLLLLLILLLVVVFFFFLIPTVLLPPDRTMSSSSSSSSSASDAAASTPFEKPRAVVKKLLAESQPEGQGATVRRSIGRHELRNLDPFLMLDEFSVSKPAGFPDHPHRGFETVTYMLEGAFTHQDFAGHKGTIRTGDVQWMTAGRGIVHSEMPAGDGVQKGLQLWINLSSKDKMIEPRYQELQSKDISRADKDGVEVRIIAGEAFGVRSPVYTRTPTMYMDFTMRPGSELHQPIPEGWNAFVYIIDGEGVFGRERSAPVGAHHCLVLGPGDGLSVWNKSGAPLRFALVGGQPLGEPVVQHGPFVMNSRAEIQQAMEDYYYGKNGFERATQWTSSSA

SEQ ID NO: 7975 - protein, 358 aa, Panicum virgatum
HRLPIAPPEKLRPSTASTTHNKLLLLLILLLVVLVVFFFFFFFLIPTVLLPPDRTMSSSSSSASDAAASTPFEKPRAVVKKLLAESQSEGQGATVRRSIGRHELRNLDPFLMLDEFSVSKPAGFPDHPHRGFETVTYMLEGAFTHQDFAGHKGTIRTGDVQWMTAGRGIVHSEMPAGDGVQKGLQLWINLSSKDKMIEPRYQELQSKDISRADKDGVEVRIIAGEAFGVRSPVYTRTPTMYMDFTMRPGSELHQPIPEGWNAFVYIIDGEGVFGRERSAPVGAHHCLVLGPGDGLSVWNKSGAPLRFALVGGQPLGEPVVQHGPFVMNSRAEIQQAMEDYYYGKNRFERATQWTSSSA

SEQ ID NO: 7976 - protein, 301 aa, Brachypodium distachyon
MSSSSASSAVAAGPLENPRAVVKKVLAESQPEGQGATVRRSIGRHELRNLDPFLMLDEFSVSKPAGFPDHPHRGFETVTYMLDGAFTHQDFSGHKGTIRTGDVQWMTAGRGIVHSEMPASDGVQKGLQLWINLSSKDKMIEPRYQELQSKDISRAEKDGVEVRIIAGEAFGVRSPVYTRTPTMYMDFTMQPGSQLHQPIPEGWNAFVYIIEGEGVFGSEKAAPASAHHCLVLGASGDGLSVWNKSGAPLRFALAAGQPLKEPVVQQGPFVMNTRAEIQQAMEDYYYGKNGFEKASQWSSST

SEQ ID NO: 7977 - protein, 96 aa, Sorghum bicolor
MASLSRTAAAVAVAVRSAARSAPVTGRVLGAPLPPLASPSAARSARILRSSAAALSAGLETLLPLHSAVAAARLRSCIAVDSSCWCSLSQGYALPL

SEQ ID NO: 7978 - protein, 94 aa, Panicum virgatum
MASLARAAAAVRSAARSAPLTGRALGAPLPSLASPSAAARRSARILRRSAAAASAGLETLMPLHSAVAAARLRSCIAVDSSCWSSLSQGYALPL

SEQ ID NO: 7979 - protein, 93 aa, Zea mays
MASLSRTAVAAVRSAARSAPLTGRVPGAPLPSLASSSAARSARILRRSAAASSSGLETLMPLHSAVAAARLRSCIAVDFSCWSSLSQGYALPL

SEQ ID NO: 7980 - protein, 96 aa, Sorghum bicolor
MASLSRTAAAAAAAVRSAVRSAPLTGRVLGAPLPSLASTSAARSARILRRSAAAASAGLETLLPLHSAVAAARLRSCIAVDSTCWSSLSQGNSLFW

SEQ ID NO: 7981 - protein, 90 aa, Triticum aestivum
LSRTAVAAVRSAARSAPLTGRVPGAPLPSLASSSAARSARILRRSAAASSSGLETLMPLHSAVAAARLRSCIAVDFSCWSSLSQGYALPL

SEQ ID NO: 7982 - protein, 616 aa, Panicum virgatum
MAAAAAATSLLLRRNRNPQLLLLRAAISSSRALPQQAELSPEPTAAAAAAAPDPAPLPPNPSTGSPFYGENWRNPAAANPPSSLLPAVVGGTAFGAHQRMAAYSDAAGLKETFAKWMAEQKWEDMKLLFDSWVRSLDTATGKPNRPDVDLFNHYLRANLMTGAMPHEMLDLADHMREFEIEPNTASYNLVLKSMVTAQEAEGAEKLVERMLQTGTVPDDESYNLVVGLLIRQNLFDSALKYLDMVLKSGHTLSLTIFTDYVRACMRSGRLDTLASIIEKCKTTDKNKVLCPQWAWCIDIAEAAFEANNSKLALFALEFLARWIVRGENVKPPAQLSVNEGLVISALSASGRTYSTDLLNAAWSLLRRSLRQKRAPTPDTYLAKIYAHSSIGQLQRAFGTLREFENAYGNSEDIDPELFSPFTSLHPLVVACCKDGFSTLDSVYVQLENLTRADPPYKSVAALNCVVLGCANIWDIDRAYETFVAIKDKFELTPDIHSYNALLCAFGKKKRTEEACNVFEHILTLGVKPNATTYSLLVDAHLANKDPKAALAVIDKMVDAGFTPSKDTLKKVRRRCSRESDFDSDEKVQSLAKQLNYRMGGENRRELLYSIEYNPVY

SEQ ID NO: 7983 - protein, 365 aa, Setaria italica
MEDDDDCPPLAVPQRAPSPPTPDPSEASPVGVTVITGYLGAGKSTLVNYILNEQHGKRIAVILNEFGEEIGVERAMINEGQGGALVEEWVELANGCVCCSVKHSLVQALEQLVQRKDRMDHILLETTGLADPAPLVSVLWLDDQLESSIRLDSIITVIDAKNFRVQIDEHKNSSSFPEAFHQIAFADVVILNKIDLVEDNLEDLEKHIHDVNTLVTVVRSVRCQVDLNEVFNRQAYGAKNSSHLQELLDYSKSIPPNRRHDNSISTLCIYEQDPVYLAKVESWLEDLLWEKNSSMDIYRCKGILHIQDSDQIHTLQVVTPLTKPHHPTRHSALPFLTSRPPISRSLSRRLLPRSATPPSLPPTPH

SEQ ID NO: 7984 - protein, 574 aa, Panicum virgatum
MEDDDDCPPLAVELPPQVPSPPAPAPPDASPVGVTVITGYLGAGKSTLVNYILNEQHGKRIAVILNEFGEEIGVERAMINEGQGGALVEEWVELANGCVCCSVKHSLVQALEQLVLRKDRMDHILLETTGLADPAPLVSVLWLDDQLESSIRLDSIITVIDAKNFRVQIDEHKNASSFPEAFHQIAFADVVILNKIDLVKDSVEDLEKHIHDVNALVTVVRSVRCQVDLNEVFNRQAYGAKNSSHLQELLDYSKSIPPNLRHDNSISTLCIYEQDPVNLAKVESWLEDLLWEKKSTMDIYRCKGILHIHDSDQVHTLQVFTQITKPPPTQHSALPFLTHHTRPSQPPSSPSPRHSSLSPTTPAKTLIPRRHGCGCGRHLASPPPQLQPPAPPPPRRDLLIPRAAPAGGALPGADRRRRARPRAAPPESQHGEPLLRRELAKPRRRQSAILAPPRRHRGHPLRGAPTHGSLLRRHGAQGDLRHVDGRAAVGGHEAALRLVGALARHRHGEAQPPRRRSLQPLPSREPHDGGHAARDARTRLPHARVRDRAQHGLVQPRAQEHGHSAGGQGRRAAR

SEQ ID NO: 7985 - protein, 610 aa, Pennisetum glaucum
MAAAAAATSLLLRRNRNPQLLLLRAAISSSRALPQQAELSPDPTTAAPDPVPLPPNPSTGSPFYGENWRNPSAANMPSSLLPAVVGGSPFGAPHRTAGASDTAELKEAFAVWMAEQRWEDMKQLFESWVRSLDAATGKPNRPDVDLFNHYLRANLMVGAGPRDMLDLLDHMHEFEVEPNTASYNLVLKSMVTALEAEGAEKLVERMLQIGTVPDDETYNLVIGLLIKQNLFDSALKYLDLMLKSGHTLSLTIFTDYVRTCVRSGRLDTLASIIEKCKTTDKNKVLCPQWAWCIDIAEAAFDANNSKLALFALEFLARWIVRGENAKIQLSVNEGLVISALSAAGRTYSTDLLNAAWSLLKKSLRQKRAPTPETYLAKIYAHSSIGQLQRAFGTLREFENAHGNSEDIDLELFSPFTSLHPLVVACCKDGFSTLDSVYIQLENLSRADPPYKSVAALNCVILGCANIWDIDRAYETFVAIKDKFELTPDIHSYNALLCAFGKKKRTEEASNVFEHISTLGVKPNATTYSLLADAHLANKDPKAALAVIDKMVEAGFTPSKDTLKKVRRRCSRESDFDSDEKVQSLAKQFNYRMGGENRREMLYNIEYNPVY

SEQ ID NO: 7986 - protein, 180 aa, Sorghum bicolor
MASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLLERVGAKVVECACVIELPELKGRDKLGDRPVFVLVEADA

SEQ ID NO: 7987 - protein, 179 aa, Setaria italica
MASGDARVAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVEANDRALVVDDLIATGGTLCAAVKLLERVGAKVVECACVIELPELKGRDKLGDRPVFVLVKAD

SEQ ID NO: 7988 - protein, 181 aa, Panicum virgatum
MASGDARVAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVEANDRALVVDDLIATGGTLCAAVKLLERVGAKVVECACVIELPELKGRDKLGDRPVFVLVKADGA

SEQ ID NO: 7989 - protein, 181 aa, Panicum virgatum
MASGDARVAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVDANDRALVVDDLIATGGTLCAAVKLLERVGAKVVECACVIELPELKGRDKLGDRPVFVLVKADGA

SEQ ID NO: 7990 - protein, 181 aa, Panicum virgatum
MASGDARVAGIASSIRVLPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVDANDRALVVDDLIATGGTLCAAVKLLERVGAKVVECACVIELPELKGRDKLGDRPVFVLVKADGA

SEQ ID NO: 7991 - protein, 179 aa, Pennisetum glaucum
MASVDARVAGIASSIRVIPDFPKPGIMFQDITTLLLDPKAFRDTIDLFVERYKDQKITVVAGVEARGFIFGPPIALAIGAKFVPLRKPKKLPGEVISEEYSLEYGTDKIEMHVGAVEANDRALVVDDLIATGGTLCAAVNLLERVGATVVECACVIELPELKGRDKLGDRPVFVLVKAD

SEQ ID NO: 7992 - protein, 180 aa, Cynodon dactylon
MASGDARVAQIASSIRVIPDFPRPGIMFQDITTLLLDPNAFRNTIDLFVERYKDKGITVVAGVEARGFIFGPPIALAIGAKFVPLRKPKKLPGAVISEEYSLEYGTDKIEMHVGAVESNDHALVVDDLIATGGTLCAAVNLLERVGAKVVECACVIELPELKGRDRLGDRPVFVLVKADA

SEQ ID NO: 7993 - protein, 233 aa, Eragrostis curvula
  misc_feature (35)..(35): Xaa can be any naturally occurring amino acid
  misc_feature (41)..(41): Xaa can be any naturally occurring amino acid
MPGCRLVHLRRPPSAPAPLPLLRQLGSRGSSARSXLRVGSXGGQQRRQRRGLAVMASGDPRVAQIASSIRVIPDFPKPGIMFQDITTLLLDPKAFRDTIDLFVERYKDKGITVVAGVEARGFILGPPIALAIGAKFVPLRKPKKLPGAVISEEYSLEYGTDKIEMHVGAVDSNDRALVVDDLIATGGTLCAAVNLLERVGAKVVECACVIELAELKGRDKLGDRPGFVLVKAD

SEQ ID NO: 7994 - protein, 252 aa, Brachypodium distachyon
MLLSPRRLHLRIPHCCSPAPAPSALLGGSGVVRRLGSGARRRGAVAMATDGRVERIASTIRVIPDFPKPGILFQDITTLLLDPQAFHDTTDLFVERYKDKGITVVAGVEARGFIFGPPIALAIGAKFVPIRKPKKLPGEVISEEYSLEYGTDKIEMHVGAVLPSDRALIVDDLIATGGTLCAAAKLIERVGAEVVECACVIELPELKRPGQVGRQASFCPCEGGLSRMKRVTFELFSLCFPSGTILEATTQS

SEQ ID NO: 7995 - protein, 181 aa, Avena sativa
MASDGRVERITSTIRVIPDFPKPGILFQDITTLLLDPQAFRDTTDLFVERYKDKGITVVAGVEARGFIFGPPIALAIGAKFVPIRKPKKLPGEVISEEYSLEYGTDKIEMHVGAVQPNDRALIVDDLIATGGTLCAAAKLIERVGAEVVECACVIELPELKGRDKLGNRPVFVLVKAEESG

SEQ ID NO: 7996 - protein, 181 aa, Triticum aestivum
MASDGRVERIASSIRAIPNFPKPGILFQDITTLLLDPQAFRDTTDLFVERYKDKDITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDMPVFVLVQADESV

SEQ ID NO: 7997 - protein, 181 aa, Leymus cinereus x Leymus triticoides
  misc_feature (37)..(37): Xaa can be any naturally occurring amino acid
MASDGRVERIASSIRAIPNFPKPGILFQDITTLLLDXQAFRDTTDLFVERYKDKSITVVAGVEARGFIFGPPIALAIGAKFVPIRKPKKLPGEVISEEYSLEYGTDKIEMHVGAVQPNDRVLIVDDLIATGGTLCAAAKLIERVGAEVVECACVIELPELKGRDKLGDRPVFVLVQADESV

SEQ ID NO: 7998 - protein, 181 aa, Pseudoroegneria spicata
MASDGRVERIASSIRAIPNFPKPGILFQDITTLLLDPQAFRDTTDLFVERYKDKDITVVAGVEARGFIFGPPIALAIGAKFVPIRKPKKLPGEVISEEYSLEYGTDKIEMHVGAVQPNDRVLIVDDLIATGGTLCASAKLIERVGAKVVECACVIELPELKGRDKLGDMPVFVLVQADESV

SEQ ID NO: 7999 - protein, 181 aa, Lolium multiflorum
MASDGRVERIASTIRVIPDFPKPGILFQDITTLLLDPQAFRDTTDLFVERYKDKGITVVAGVEARGFIFGPPIALAIGAKFVPIRKPKKLPGEVISEEYSLEYGTDKIEMHVGAVQPNDRVVIVDDLIATGGTLSAAAKLIERVGAEVVECACVIELPELKGRDKLGNRPVFVLVQAEESG

SEQ ID NO: 8000 - protein, 181 aa, Secale cereale
MASDGRVERIASSIRAIPNFPKPGILFQDITTLLLDTQAFRDTTDLFVERYKDKDITVVAGVEARGFIFGPPIALAIGAKFVPIRKPKKLPGEVISEEYSLEYGTDKIEMHVGAVQPKDRVLIVDDLIATGGTLCAAAKLIERVGAEVVECACVIELPELKGRDKLGDRPVFVLVQADESV

SEQ ID NO: 8001 - protein, 183 aa, Eucalyptus grandis
MASQGGQDPRLAKIASSIRVIPDFPKPGIMFQDITTLLLNPEAFKDTIDLFVERYREQNISVVAGVEARGFIFGPPIALAIGAKFVPMRKPNKLPGEVISEEYSLEYGTDTMEMHVGAVQPGDRALIVDDLIATGGTLCAAIKLIERVGAEVVECACAIELPELKGRDRLGDKPLFVLVSSDI

SEQ ID NO: 8002 - protein, 184 aa, Trigonella foenum-graecum
MASKDSQDPRIAGISSSIRIIPDFPKPGIMFQDITTLLLDTKAFKDTIDLFVERYKDQNISVVAGVEARGFIFGPPIALAIGAKFVPMRKPKKLPGEVISEEYSLEYGTDKIEMHVGAVQSGERALVIDDLIATGGTLCAAIKLLERVGVTVVECACVIELPELKGREKLGGKPLFVLVEGEGA

SEQ ID NO: 8003 - protein, 240 aa, Oryza sativa
MTSPPPPPSSLLRRLPTTRCCCFASASSGWSASASVRLGSLGGKQRRGHRGVAVMAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 8004 - protein, 179 aa, Euphorbia peplus
MAAQDPRIKGISSSIRVIPDFPKPGIMFQDITTLLLDTKAFKDTIDLFVERYKDMNISVVAGVEARGFIFGPPIALAIGAKFVPMRKPNKLPGEVISEEYSLEYGTDKIEMHVGAVQAGERALVIDDLIATGGTLCAAIKLLERVGVRVVECACVIELAELKGRDRLGETPLFVLVNSA

SEQ ID NO: 8005 - protein, 183 aa, Cicer arietinum
MASQDQDPRIARISSAIRVIPDFPKPGIMFQDITTLLLDTKAFKDTIDLFVERYRDQNISVVAGVEARGFIFGPPIALAIGAKFVPMRKPKKLPGEVISEEYSLEYGTDKIEMHVGAVQPGERALVIDDLIATGGTLCAAIKLLERVEVTVVECACVIELPELKGRERLGDRSLFVLVEAEGA

SEQ ID NO: 8006 - protein, 181 aa, Elaeis guineensis
MASEDGKDHRLARISSSIRVIPDFPKPGIMFQDITTLLLDHKAFRDTIDIFVERYREKNISVVAGIEARGFIFGPPIALAIGAKFVPMRKPKKLPGEVISEEYALEYGTDKMEMHVGAVQPGDRALVIDDLIATGGTLCAAVRLLERVGADVVECACVIELPELKGREKLGHRPVFVLVKG

SEQ ID NO: 8007 - protein, 180 aa, Solanum lycopersicum
MAPHDLKDERIAGIASAIRVIPDFPKPGIMFQDITTLLLDPKAFKDTIDLFVERYKDKNISVVAGIEARGFIFGPPIALAIGAKFVPMRKPKKLPGEVISEEYSLEYGTDKIEMHVGAVQAGERALVVDDLIATGGTLSAAIRLLERVGVEVVECACVIELPELKGRERLGDKPLFVLVS

SEQ ID NO: 8008 - protein, 62 aa, Fraxinus spp
MAAQIVDSTDDRISRISSSIRVIPDFPKPGIMFQDITTLLLDPKAFKDTIDLFVERYKDQKY

SEQ ID NO: 8009 - protein, 176 aa, Antirrhinum majus
MASDDRITRISSSIRVIPDFPKPGIMFQDITTLLLDPKAFKDTIDLFVERYKDKNISVVAGIEARGFIFGPPIALAIGAKFVPMRKPKKLPGEVISEEYSLEYGTDKIEMHVGAVQSGERAVIVDDLIATGGTLNAAIRLLERVGVNVVECACVIELPELKGRDKLGDKSLFVLVN

SEQ ID NO: 8010 - protein, 178 aa, Primula obconica
MGSDDRIAKITAAIRVIPDFPKPGIMFQDITTLLLDPKAFKDTIDLFVERYKDKGISVVAGVEARGFIFGPPIALAIGAKFVPMRKPKKLPGEVISEEYSLEYGTDKIEMHVGAVQAGERALVIDDLIATGGTLCAAVRLLERVGVQVFECACVIELAGLKGRERLGEKPLFVLVSSD

SEQ ID NO: 8011 - protein, 184 aa, Medicago truncatula
MASKDSQDPRIARISSSIRIIPDFPKPGIMFQDITTLLLDTKAFKDTIDLFVERYRDQNISVVAGVEARGFIFGPPIALAIGAKFVPMRKPKKLPGEVISEEYSLEYGTDKIEMHVGAVQTGERALVIDDLIATGGTLCAAIKLLERVGVTVVECACVIELPELKGRAKLGGKPLFVLVEGEGA

SEQ ID NO: 8012 - protein, 182 aa, Curcuma longa
MASDGAEDHRLPRIASSIRVIPDFPKPGILFQDITTLLLDPEAFKDTIDMFVERYRDKEISVVAGIEARGFIFGPPIALAIGAKFVPMRKPKKLPGEVISEEYSLEYGTDKMEMHVGAVQAGDRALVIDDLIATGGTLAAAMRLLDRVGAEVVECACVIELPELKGRDKLGGRPLFVLVKAV

SEQ ID NO: 8013 - protein, 182 aa, Arachis hypogaea
MASDDAQDPRLQRISSAIRVIPDFPKPGIMFQDITTLLLDTKAFKDTIDLFVERYRDQNISVVAGVEARGFIFGPPIALAIGAKFVPMRKPNKLPGEVISEEYSLEYGTDKMEMHVGAVQRGDRALVIDDLIATGGTLCAAIKLLERVQAQVVECACVIELPELKGRDKLTGKPLFVLVKGA

SEQ ID NO: 8014 - protein, 194 aa, Olea europaea
MAAQIGDSTADRISRISSSIRVIPDFPKPGIMFQDITTLLLDPKAFKYTIDLFVERYTGQNISVVAGVEARGFIFGPPIALAIGAKFVPMRKPKKLPGEVISEEYSLEYGTDKMEMHVGAVQAGERALVVDDLIATGGTLSAAIRLLERVGVDVVECACVIELPELKGRNRLGDKPLFVLVSEVDTVVKLDNEI

SEQ ID NO: 8015 - protein, 184 aa, Nicotiana benthamiana
MASKDPILKDDRIARISSSIRVIPDFPKPGIMFQDITTLLLDTKAFKDTIDLFVERYKDKNISVVAGIEARGFIFGPPIALAIGAKFVPMRKPKKLPGEVISEEYSLEYGTDKIEMHVGAVQAGERALVVDDLIATGGTLSAAIRLLERVGVEVVECACLIELPELKGRDRLGDKPLFVLVSST

SEQ ID NO: 8016 - protein, 184 aa, Solanum melongena
MAAHEPILKDDRIAGISSAIRVIPDFPKPGIMFQDITTLLLDTKAFKDTVDLFVERYKDKNITVVAGVEARGFIFGPPIALAIGAKFVPMRKPKKLPGEVISEEYSLEYGTDKMEMHVGAVQASDRALVVDDLIATGGTLTAAIRLLERVGAVVVECACVIELPELKGRDRLGDKPLFVLVNSA

SEQ ID NO: 8017 - protein, 179 aa, Lotus japonicus
MASQDPRIATISSAIRVIPDFPKPGIMFQDITTLLLDPKAFKDTIDLFVERYRDQNISVVAGVEARGFIFGPPIALAIGAKFVPMRKPKKLPGPVISEEYSLEYGTDKIEMHVGAVQAGERALIIDDLIATGGTLSAAIRLLERVEVQVVECACVIELPELKGRERLGDKALFVLVNGS

SEQ ID NO: 8018 - protein, 184 aa, Phalaenopsis aphrodite
MASLEEKNRIARVASSIRAIPNFPKPGVMFQDITTLLLDPKAFRDAVDLFVERYRDQRISVVAGVEARGFIFGPPIALAIGAKFVPLRKPKKLPGEVISEEYLLEYGTDKIEMHVGAVQPDDRAVVIDDLIATGGTLCAAIKLLERVGAEVVECACVIELPELKGREKLGERPLFVLVNGACLT

SEQ ID NO: 8019 - protein, 182 aa, Platanus occidentalis
MTSEDGHDHRIDRISSAIRVIPDFPKPGILFQDITTLLLDPKAFKDTIDLFVERYKDKNISVVAGIEARGFIFGPPIALAIGAKFVPLRKPKKLPGEVISEEYSLEYGTDKIEMHVGAVQKGERALVIDDLIATGGTLCAAINLLERVGVEVVECACVIELQELKGRDRLGDKPLFVLVNAV

SEQ ID NO: 8020 - protein, 83 aa, Carpinus betulus
MASQDAQEGQDGRVARIASAIRVIPDFPKPGIMFQDITTLLLDTKAFRDTIDLFVERYKDKDISVVAGIEARGFIFGLPLHWL

SEQ ID NO: 8021 - protein, 179 aa, Vaccinium corymbosum
MAAVDDRIAAIAESIRIIPDFPKPGIMFQDITTLLLDPKAFKDTIDLFVERYKDKNISVVAGVEARGFIFGPPIALAIGAKFVPMRKPNKLPGEVISEEYTLEYGTDKIEMHVGAVQAGERALVIDDLIATGGTLCAAMNLLERVGVDVVECACVIELAELKGRERLRGKPLFVLVSST

SEQ ID NO: 8022 - protein, 182 aa, Fraxinus spp
MAAQNVDSTDDRISRISSSIRVIADFPKPGILFQDITTLLLDPKAFKDTIDLFVERYKEQNINVVAGIEARGFIFGPPIALAIGAKFVPLRKPKKLPGEVISEEYSLEYGTDIMEMHVGAVQAGERALVVDDLIATGGTLSAAIRLLERVGVDVVECACVIELPELKGRNLLGDKPLFVLVS

SEQ ID NO: 8023 - protein, 185 aa, Orobanche aegyptiaca
MGSSDVNNTDDRISRISSSIRVIPNFPKPGIMFQDITTLLLDPKAFKDTIDLFVERYKDKNINVVAGVEARGFIFGPPIALAIGAKFVPMRKPKKLPGEVISEEYSLEYGTDKIEMHVGAVQIGERAIVVDDLIATGGTLTAAINLLERVGVDVVECACVIELPELKGRDRLGDKQLFVLVSSST

SEQ ID NO: 8024 - protein, 185 aa, Allium cepa
MASAENNNADIRISKIASSIRVIPNFPKPGVMFQDITTLLLEPKIFRDAIDLFVERYRDKNITVVAGVEARGFIFGPPIALDIGAKFVPIRKPKKLPGEVVSEEYSLEYGTDKIEMHVGAVQPGDRVLVVDDLIATGGTLGAAVKLIERVGAEVVECACLIEMPELKGREKLGNRSLFVLVEADA

SEQ ID NO: 8025 - protein, 184 aa, Nicotiana tabacum
MASKDPILKDDRIARISSSIRVIPDFPKPGIMFQDITTLLLDTKAFKDTIDLFLERYKDKNISVVAGIEARGFIFGPPIALAIGAKFVPMRKPKKLPGEVISEEYSLEYGTDKIEMHVGAVQAGERALVVDDLIATGGTLAAAIRLLERVGVEVVECACLIELPELKGRDRLGDKPLFVLVSST

SEQ ID NO: 8026 - protein, 189 aa, Linum usitatissimum
MAAANDHQDPRLAGIASAIRVIPDFPKPGIMFQDITTLLLDVKAFKDTIDLFVERYKDKGISVVAGIEARGFIFGPPLALAIGAKFVPLRKPKKLPGEVISEEYSLEYGTDKIEMHVGAVQAGERALVVDDLIATGGTLKAAINLLERVGVEVYECACLIELPELKGRDRLGDKPLFVLVSSTIEANDF

SEQ ID NO: 8027 - protein, 189 aa, Linum usitatissimum
MAAANDHQDPRLAGIASAIRVIPDFPKPGIMFQDITTLLLDVKAFKDTIDLFVERYKDKGISVVAGIEARGFIFGPPLALAIGAKFVPLRKPKKLPGEVISEEYSLEYGTDKIEMHVGAVQAGERALVVDDLIATGGTLKAAINLLERVGVEVYECACLIELPELKGRDRLGDKPLFVLVTSTIEAHDF

SEQ ID NO: 8028 - protein, 180 aa, Ambrosia trifida
MAGPTSDDDRISRITSAIRVIPDFPKPGILFQDITTLLLDPVAFKDTIDLFVERYKDKDISVVAGVEARGFIFGPPIALAIGAKFVPMRKPNKLPGPVISEEYSLEYGTDKIEMHVGAVQAGDRALVLDDLIATGGTLCAAINLLERVGAHVVECACVIELPELKGRDRLGDKPLFVLVS

SEQ ID NO: 8029 - protein, 183 aa, Cucurbita pepo
MASIDVEDPRIAKIAKAIRVIPDFPKPGILFQDITTLLLDTKAFRDTIDLFVERYRGKDITVVAGIEARGFIFGPPIALAIGAKFVPMRKPKKLPGEVISEEYSLEYGTDKIEMHVGAVEAGERALVIDDLIATGGTLCAAIRLLERVGVDVVECACVIELHGLKGRERLGDKPLFVLVNAAA

SEQ ID NO: 8030 - protein, 103 aa, Phalaenopsis aphrodite
MASIDQDTRIKRIASSIRIIPNFPKDGVMFQDITTLLLDPKAFRDTVELFVERYRDMRISVVAGVEARGFIFGPPIALAIGAKFVPLRKPKSYQVKSFQKNIL

SEQ ID NO: 8031 - protein, 186 aa, Phaseolus vulgaris
MALKDAQDQQDPRLERISSAIRVIPDFPKPGILFQDITTLLLDPKAFKDTIDLFVERYRDQNINVVAGVEARGFIFGPPIALAIGAKFVPMRKPNKLPGEVISEEYSLEYGTDKIEMHVGAVQPGERALVIDDLIATGGTLDAAIKLLERVGVDVVECACLIELPELKGRDRLGDKPLFVLVKVTA

SEQ ID NO: 8032 - protein, 185 aa, Aquilegia formosa
MGSKEGTDHRIARISSAIRVIPNFPKPGILFQDITTLLLDPKAFKDTIDLFVERYKDKEISVVAGIEARGFIFGPPIALAIGAKFVPMRKPKKLPGEVISEEYSLEYGTDKIEMHVGAVEPGERALIIDDLIATGGTLCAAIRLLERVGVKVVECACVIELPELEGRKRLGDKPLFVLVEAADQI

SEQ ID NO: 8033 - protein, 184 aa, Glycine max
MASKNAQQDTRLARIASAIRVIPDFPKPGILFQDITTLLLDTKAFKDTVDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRDRLGDKSLFVLIKGGA

SEQ ID NO: 8034 - protein, 191 aa, Tabernaemontana elegans
MASSAAEADHHQSPAVDDRIPRIASAIRVIPDFPKPGIMFQDITTLLLDPEAFKDTIDLFVERYRDEKINVVAGIEARGFIFGPPIALAIGAKFVPFRKPKKLPGEVISEEYSLEYGTDKMEMHVGAVQAGERAVIVDDLIATGGTLTAAIRLLERVGVEVVECACVIELPELKGRDRLGDKPLFVLVSSD

SEQ ID NO: 8035 - protein, 183 aa, Tragopogon dubius
MAPPTSDGLKDDRISRITSAIRVIPDFPKPGILFQDITTLLLDPVAFKDTIDLFVERYKDKDISVVAGVEARGFIFGPPIALAIGAKFVPMRKPNKLPGAVISEEYSLEYGTDKIEMHVGAVQEGERALVIDDLIATGGTLCAAISLLERVGVKVVECACVIELPDLKGRARLGDKPLFVLVS

SEQ ID NO: 8036 - protein, 184 aa, Nicotiana tabacum
MASNDPILKDDRIVRISSSIRVIPDFPKPGIMFQDITTLLLDTKAFKYTIDLFVERYKDKNISVVAGIEARGFIFGPPIALAIGAKFVPMRKPKKLPGEVISEEYSLEYGTDKIEMHVGAVQAGERALVVDDLIATGGTLTAAIRLLERVGVEVVECACLIELPELKGRDRLGDKPLFVLVSST

SEQ ID NO: 8037 - protein, 182 aa, Olea europaea
MAAQNVDSTDDRISGISSSIRVIPDFPKPGIMFQDITTLLLDPKAFKDTIDLFVERYKDQNINVVAGIEARGFIFGPPIALAIGAKFVPMRKPKKLPGEVISEEYSLEYGTDIMEMHVGAVQAGERALVVDDLIATGGTLSAAIRLLERVGVDVVECACVIELPELKGRNRLGDKPLFVLVT

SEQ ID NO: 8038 - protein, 181 aa, Capsicum annuum
MAASHDVKDARIAGISSAIRVIPDFPKPGIMFQDITTLLLDTKAFKDTIDLFVERYKDKNISVVAGIEARGFIFGPPIALAIGAKFVPMRKPKKLPGEVISEEYSLEYGTDKMEMHVGAVEAGERALVVDDLIATGGTLNAAIRLLERVEVEVVECACVIELPELKGRERLGDKPLFVLVN

SEQ ID NO: 8039 - protein, 164 aa, Amorphophallus konjac
MASRDSAEDPRLARIASAIRVIPDFPKPGILFQDITTLLLDTKAFRDTIDMFVERYRDMNISVVAGIEARGFIFGPPIALAIGAKFVPMRKPKKLPGEVISEEYSLEYGTDRMEMHVGAVQAGNVLLLLMILLQLGEPYLLQSGYLNVLVWMWLNVHVSLNYRS

SEQ ID NO: 8040 - protein, 182 aa, Vitis vinifera
MASEDAQDHRIARISSAIRVIPDFPKPGIMFQDITTLLLDPQAFKDTIDLFVERYKGKNISVVAGIEARGFIFGPPIALAIGAKFVPMRKPNKLPGAVISQEYALEYGTDKIEMHVGAVQAGERALVIDDLIATGGTLCAAINLLERVEVDVVECACVIELPELKGRDRLGDKPLFVLVSAA

SEQ ID NO: 8041 - protein, 190 aa, Cleome spinosa
MAGEDGQDPRIPKIASAIRVIPNFPKPGIMFQDITTLLLDTRAFRDTIDLFVERYKGKDISVVAGVEARGFIFGPPIALAIGAKFVPMRKPKKLPGEVISEEYSLEYGTDKIEMHVGAVQPGERALVIDDLIATGGTLCAAIRLLERVGVKVVECACVIELPELKGREKLGETPLFILVSSTEPEKETEA

SEQ ID NO: 8042 - protein, 180 aa, Papaver somniferum
MAAVEDDRIARISSAIRVIPNFPKPGIMFQDITTLLLDPKAFKDTIDLFVERYKDKNISVVAGMEARGFIFGPPIALAIGAKFVPMRKPKKLPGEVISEEYSLEYGTDKLEMHVGAVQAGERALIVDDLIATGGTLCAGIRLLERVGAEIVECACLIELAELKGRDRLGGKPLFILVSAA

SEQ ID NO: 8043 - protein, 179 aa, Cleome spinosa
EDGTDPRIPKIASAIRVIPNFPKPGIMFQDITTLLLDTQAFKDTIDLFVERYKGKDISVVAGVEARGFIFGPPIALAIGAKFVPMRKPKKLPGEVISEEYSLEYGTDKIEMHVGAVQPGERALVIDDLIATGGTLCAAIRLLERVGVKVVECACVIELAELKGREKLGETPLFVLVSST

SEQ ID NO: 8044 - protein, 186 aa, Trifolium pratense
MASKDSKDQDPRIARISSAIRIIPDFPKPGIMFQDITTLLLDTKAFKDTIDLFVERYRDQNISVVAGVEARGFIFGPPIALAIGAKFVPMRKPKKLPGEVISEEYSLEYGTDKIEMHVGAVQPGERALVIDDLIATGGTLCAAIKLLERVGVNVVECACVIELPELKGREKLGGKSLFILVEGEGA

SEQ ID NO: 8045 - protein, 93 aa, Ambrosia trifida
MRKPNKLPGPVISEEYSLEYGTDKIEMHVGAVQTGDRALVIDDLIATGGTLCAAINLLERVGAHVVECACVIELPELKSQDRLGDKPLFVLVS

SEQ ID NO: 8046 - protein, 225 aa, Centaurea maculosa
  misc_feature (36)..(36): Xaa can be any naturally occurring amino acid
  misc_feature (44)..(45): Xaa can be any naturally occurring amino acid
GGQKRSSPRHGTRRRTNRWPPFPHSKPQHQLKLQLXLLLSHGGXXSRCGHKQDDRISRITSAIRVIPDFPKPGILFQDITTLLLDPVAFKDTIDLFVERYKDKDISVVAGVEARGFIFGPPIALAIGAKFVPMRKPNKLPGAVISQEYSLEYGTDKIEMHVGAVQEGERALVIDDLIATGGTLCAAISLLERVGVKVVECACVIELPELKGRDRLGDKPLFVLVS

SEQ ID NO: 8047 - protein, 189 aa, Cirsium arvense
MAAPTSDGHKEDIVVKDDRISRITSAIRVIPDFPKPGILFQDITTLLLDPVAFKDTIDLFVERYKDKDISVVAGVEARGFIFGPPIALAIGAKFVPMRKPNKLPGAVISQEYSLEYGTDKIEMHVGAVQEGERALVIDDLIATGGTLCAAISLLERVGVKVVECACVIELPELKGRDRLGDKPLFVLVS

SEQ ID NO: 8048 - protein, 186 aa, Vigna unguiculata
MALKNAKDEQDPRLERISSAIRVIPDFPKPGILFQDITTLLLDPKAFKDTIDLFVERYRDQNINVVAGVEARGFIFGPPIALAIGAKFVPMRKPNKLPGEVISEEYSLEYGKDKIEMHVGAVLPGERALVIDDLIATGGTLDAAIKLLERVGVDVVECACLIELPELKGRDRLGNKPLFVLVKVTA

SEQ ID NO: 8049 - protein, 184 aa, Ipomoea batatas
MASHDPASKDTRIAQISSAIRVIPDFPKPGIMFQDITTLLLDPKAFKDTIDLFVERYQDKKINVVAGIEARGFIFGPPIALAIGAKFVPMRKPKKLPGEVISEEYSLEYGTDVMEMHVGAVQEGERVLIIDDLIATGGTLGAAIRLIERVGGTVVECACVIELPELKGRARLGDKPLFVLVSST

SEQ ID NO: 8050 - protein, 260 aa, Papaver somniferum
METFGISSVNGNLISSSPITTNNNSPHLSNMMNSSVSLKTSFICNGNDTPNFRSSSKRITVPKIRSFSANNSKKLSQENLKDGLQDDRIARISSAIRLIPDFPKPGIMFQDITTLLLDPKAFQDTIDLFVERYKNKDITVVAGMEARGFIFGPPIALAIGAKFVPMRKPKKLPGEVISEEYTLEYGTDKLEMHVGAVQAGERALIVDDLIATGGTLCAGIRLLERVGAEVVECACLIELPELKGRDRLGNKPLFILVSAV

SEQ ID NO: 8051 - protein, 157 aa, Papaver somniferum
MAAVEDDRIARISSAIRVIPNFPKPGIMFQDITTLLLDPKAFKDTIDLFVERYKDKNISVVAGMEARGFIFGPPIALAIGAKFVPMRKPKKLPGEVISEEYSLEYGTDKLEMHVGAVQAGERALIVDDLIATGGDFMCWNQAIGTCRRRDSRVCLSD

SEQ ID NO: 8052 - protein, 185 aa, Thalictrum flavum
MGSRAGEDNRIARISSAIRVIPNFPKPGILFQDITTLLLDPRAFKDTIDLFVERYKDKEISVVAGIEARGFIFGPPIALAIGAKFVPMRKPKKLPGEVISEEYSLEYGTDKIEMHVGAAESGERALIIDDLIATGGTLCAAIRLLERVGVKVVECACVIELPELEGRKRLGDKPLFVLVEAADQI

SEQ ID NO: 8053 - protein, 185 aa, Thalictrum flavum
MGSKAGEDNRIARISSAIRVIPNFPKPGILFQDITTLLLDPRAFKDTIDLFVERYKDKEISVVAGIEARGFIFGPPIALAIGAKFVPMRKPKKLPGEVISEEYSLEYGTDKIEMHVGAVESGERALIIDDLIATGGTLCGAIRLLERVGVKVVECACVIELPELEGRKRLGDKPLFVLVEAADQI

SEQ ID NO: 8054 - protein, 187 aa, Vinca minor
MAPTGEADQNAVVVDDRIPRISAAIRVIPDFPKQGIMFQDITTLLLDPRAFKDTIDLFVERYGDKNINVVAGIEARGFIFGPPIALAIGAKFVPFRKPKKLPGEVISEEYSLEYGTDIMEMHVGAVQAGDRALIVDDLIATGGTLCAAIRLLERVGAEVVECACVIELPELKGRDRLGDKPLFVLVS

SEQ ID NO: 8055 - protein, 183 aa, Petunia hybrida
MASHDPILVDERIPRISSAIRVIPDFPKPGIMFQDITTLLLDTKAFKDTIDLFVERYKDKKISVVAGIEARGFIFGPPIALAIGAKFVPMRKPKKLPGEVISEEYSLEYGTDKIEMHVGAVEAGERALVVDDLIATGGTLTAAIRLLERVGVEVVECACLIELPELKGRDRLGDKPLFVLVSS

SEQ ID NO: 8056 - protein, 182 aa, Solanum phureja
MAPHDPILKDERIAGIASAIRVIPDFPKPGIMFQDITTLLLDPKAFKDTIDLFVERYKDKNISVVAGIEARGFIFGPPIALAIGAKFVPMRKPKKLPGEVISEEYSLEYGTDKMEMHVGAVQAGERALVVDDLIATGGTLTAAIRLLERVGVEVFECACVIELPELKGRERLGDKPLFVLVS

SEQ ID NO: 8057 - protein, 184 aa, Glycine max
MASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRERLGDKSLFVLINGGA

SEQ ID NO: 8058 - protein, 184 aa, Fagus grandifolia
MAAGDVQDPRIQKIASAIRVIPDFPKPGILFQDITTLLLDTKAFRDTIDLFVERYKDKGISVVAGIEARGFIFGPPIALAIGAKFVPMRKPNKLPGEVISEEYSLEYGTDIMEMHVGAVEAGERALVIDDLIATGGTLCAAIRLLERVGVHVFECACVIELPELKGRDRLGDKPLFVLVNAAGV

SEQ ID NO: 8059 - protein, 183 aa, Unknown
  Sequence found in Organisms: Populus trichocarpa, Picea glauca
MATADEQQDPRIARISSAIRVIPDFPKPGIMFQDITTLLLDTKAFKDTIDLFVERYRDKNISVVAGVEARGFIFGPPIALAIGAKFVPMRKPNKLPGEVISEEYSLEYGTDKMEMHVGAVEAGEHALVIDDLIATGGTLCAAVKLLERVGVHVVECACVIELLGLKGRERLGDRPLFVLVNST

SEQ ID NO: 8060 - protein, 183 aa, Cannabis sativa
MALKDGQDDRIARISSAIRVIPNFPKPGILFQDITTLLLDTKAFKDTIDLFVERYKDKRISVVAGVEARGFIFGPPIALAIGAKFVPMRKPHKLPGEVISEEYSLEYGTDKIEMHVGAVEAGERALIIDDLIATGGTLCAAIRLLERVGVDVVECACVIELPELKGRARLGGKPLFVLVDAAA

SEQ ID NO: 8061 - protein, 183 aa, Malus domestica
MAAEDGQDLRLARISSAIRVIPNFPKPGIMFYDITTLLLDTKAFKDTIDLFVERYKDKEISVVAGVEARGFIFGPPIALAIGAKFVPLRKPKKLPGKVISEEYSLEYGTDIMEMHVGAVEAGERALIIDDLIATGGTLGAAIKLLERVGVHVVECACVIELPELKGRERLGEKPLFVLVSGDA

SEQ ID NO: 8062 - protein, 183 aa, Cucurbita pepo
MASTDEQDPRIAKIAKAIRVIPDFPKPGILFQDITTLLLDIKAFRDTIDLFVERYRGKDISVVAGIEARGFIFGPPIALAIGAKFVPMRKPKKLPGEVISEEYSLEYGTDKIEMHVGAVEAGERALVIDDLIATGGTLCAAIRLLERVGVEVVECACVIELQGLKGRERLGGKPLFVLVNAMA

SEQ ID NO: 8063 - protein, 180 aa, Euphorbia peplus
MAAQHEKDPRIEGISSSIRVIPDFPKPGIMFQDITTLLLDTKAFKDTIDLFVERYKGQDISVVAGVEARGFIFGPPIALAIGAKFVPMRKPNKLPGEVISEEYSLEYGTDKMEMHVGAVQAGERALIIDDLIATGGTLCAAIRLLERVGVHVVECACVIELPELKGRDRLGETPLFVLVN

SEQ ID NO: 8064 - protein, 180 aa, Helianthus annuus
MAAPTSDDDRISRITSAIRVIPDFPKPGILFQDITTLLLDPVAFKDTIDLFVERYKDKDISVVAGVEARGFIFGPPIALAIGAKFVPMRKPNKLPGPVISEEYSLEYGKDKIEMHVGAVEAGDRALVIDDLIATGGTLCAAINLLERVGAHVVECACVIELPELKGRDRLGDKPLFVLVS

SEQ ID NO: 8065 - protein, 186 aa, Cajanus cajan
MASKNAQDQQDSRLESISSAIRVIPDFPKPGIMFQDITTLLLDTKAFKDTIDLFVERYRDKNISVVAGIEARGFIFGPPIALAIGAKFVPMRKPNKLPGEVISEEYSLEYGTDKMEMHVGAVQPGDRALIIDDLIATGGTLGAAIKLLERVGVHVVECACVIELPELKGRDRLGDKPLFVLVKGMA

SEQ ID NO: 8066 - protein, 185 aa, Valeriana officinalis
MAAPVDLDSNIDRIARISSAIRVIPDFPKPGIMFQDITTLLLDPKAFKDTIDLFVERYKDKNISVVAGIEARGFIFGPPIALAIGAKFVPIRKPKKLPGEVISEEYSLEYGTDKIEMHVGAVNNGERALVIDDLIATGGTLAAAIKLLERVGANVVECACVIELAELKGRDRLGDRPLFVLVSST

SEQ ID NO: 8067 - protein, 184 aa, Nicotiana benthamiana
MAHKDPILKDDRIARISSSIRVIPDFPKPGIMFQDITSLLLDTKAFKDTIDLFVERYEDKNISVVAGIEARGFIFGPPIALAIGAKFVPMRKPKKLPGEVISEEYSLEYGTDKIEMHVGAVQAGERAFVVDDLIATGGTLTAAIRLLERVGVEVVECACLIELPELKGRDRLGDKPLFVLVSST

SEQ ID NO: 8068 - protein, 177 aa, Brassica juncea
DPRIPKIASSIRVIPDFPKPGIMFQDITTLLLDTEAFRDTIDIFVERYKGKGISVVAGVEARGFIFGPPIALAIGAKFVPMRKPKKLPGKVISEEYSLEYGTDKIEMHVGAVEPGERAIIIDDLIATGGTLAAAIRLLERVGVKIVECACVIELPELKGREKLGEAPLFILVTSDAA

SEQ ID NO: 8069 - protein, 182 aa, Unknown
  Sequence found in Organisms: Citrus clementina, Citrus sinensis
MASADVKAQDPRIAGISSAIRVIPDFPKPGIMFQDITTLLLDTKAFRDTIDLFVERYKDKNISVVAGIEARGFIFGPPIALAIGAKFVPMRKPKKLPGEVISEEYSLEYGKDVMEMHVGAVQAGERALIVDDLVATGGTLSAAIRLLERVGVHVVECACVIELPELKGRERLGEKPLFVLVS

SEQ ID NO: 8070 - protein, 188 aa, Flaveria ramosissima
MATPTSDGHRDDVVKDDRIARITSSIRVIPDFPKPGILFQDITTLLLDPVAFKDTIDLFVERYKDKEISVVAGVEARGFIFGPPIALAIGAKFVPMRKPNKLPGAVISEEYSLEYGTDKIEMHVGAVEAGERALVIDDLIATGGTLRAAINLLERVGVNVVECACVIELPELKGRDRLAGKPLFVLVS

SEQ ID NO: 8071 - protein, 182 aa, Unknown
  Sequence found in Organisms: Pinus pinaster, Pinus taeda
MSASEDGDARVQGIFNAIRVVPDFPKPGIMFQDITTLLLDHKAFRDSIDIFVERYKDKNIAVVAGIEARGFIFGPPIALAIGAKFVPIRKPKKLPGEVISEEYALEYGTDRIEMHVGAVQPGDRTLVVDDLIATGGTLSAAMRLLERVGAEVVECACVIELPELKGREKLGGKPLFILVESA

SEQ ID NO: 8072 - protein, 185 aa, Mimulus guttatus
MASANVGETDDRISRISSTIRVIPDFPKPGIMFQDITTLLLDHKAFKDTIDLFVERYKDKNINVVAGIEARGFIFGPPIALAIGAKFVPMRKPKKLPGKVISEEYSLEYGTDKMEMHVGAVEAGERALIVDDLIATGGTLNAAIRLLERVEVTVVECACVIELPELKGRDKLGDKPLFVLVSSSI

SEQ ID NO: 8073 - protein, 182 aa, Olea europaea
MAAQNVDSTDDRISRISSSIRVIPDFPKPGIMFQDITTLLLDPKAFKDTIDLFVERYEDQNINVVAGIEARGFIFGPPIALAIGAKFVPMRKPKKLPGEVISEEYSLEYGTDIMEMHVGAVQAGERALVVDDLIATGGTLSAAIRLLERVGVDVVECACVIELPELKGRNRLGDKPLFVLVT

SEQ ID NO: 8074 - protein, 190 aa, Lippia dulcis
MSVMAHAASSNVDERDARISRISSSIRVIPDFPKPGIMFQDITTLLLVPEAFKDTIDLFVERYKDKNINVVAGVEARGFIFGPPIALAIGAKFVPMRKPNKLPGEVISEEYSLEYGTDTMEMHVGAVKSGERAIVVDDLIATGGTLRAAINLLERVEVKVVECACVIELPELKGRDKLADKPLFVLVSSA

SEQ ID NO: 8075 - protein, 182 aa, Solanum tuberosum
MAPHDPILKDERIAGIASAIRVIPDFPKPGIMFQDITTLLLDPKAFKDTIDLFVERYKDKNISVVAGIEARGFIFGPPIALAIGAKFVPMRKPKKLPGEVISEEYSLEYGTDKMEMHVGAVQAGECALVVDDLIATGGTLSAAIRLLERVGVEVFECACVIELPELKGRERLGDKPLFVLVS

SEQ ID NO: 8076 - protein, 183 aa, Triphysaria pusilla
MASSDLNDTDNRISRISSSIRVIPDFPKPGILFQDITTLLLDPKAFKDTIDLFVERYKDKHINVVAGVEARGFIFGPPIALAIGAKFVPMRKPKKLPGEVISEEYSLEYGTDKIEMHVGAVQSGERAIVVDDLIATGGTLNAAIRLLERVGVDVVECACVIELPELKGRDKLGDKKLFVLVSS

SEQ ID NO: 8077 - protein, 182 aa, Tripterygium wilfordii
MAGSAADGKDPRVAGIASAIRVIPDFPKPGILFQDITTLLLDPKAFKDTVDLFVERYKGKDISVVAGIEARGFIFGPPIALAIGAKFVPMRKPKKLPGEVISEEYSLEYGTDIMEMHVGAVQAGERALIIDDLIATGGTLCAAIRLLERVGVEVVECACVIELPELKGRERLGDKPLFVLVS

SEQ ID NO: 8078 - protein, 1479 aa, Zea mays
MEKVWESGRRMSRSIGRGMGMEAWGVDDVFMPQHGSRSRTSSRGGRVDDDEEALRWAAIERLPTYSRVRTAILSEAAAVGGVNDDDDGGKQQRFKEVDVRKLGVGERQEFIERVFRVAEEDNQRFLQKLRNRIDRVGIELPTVEVRFERLTVQAKCHVGSRALPTLLNTARNIAEGALGLCGVRLGRQARLTILGDVSGAVRPSRMTLLLGPPSSGKTTLLLALAGKLDPALTRAGEVTYNGFRLDEFVPQKTAAYISQTDVHVGEMTVKETLDFSARCQGVGTKYDLMTELARREKEAGIRPEPEVDLFMKILGLDICADTIVGDQMQRGISGGQKKRVTTGEMIVGPTKVLFMDEISTGLDSSTTFQIVKCLQQIVHLGEATILMSLLQPAPETFDLFDDIILLSEGQIVYQGPREHVLEFFESCGFSCPERKGTADFLQEVTSRKDQEQYWADKQRPYRYISVPEFAQRFQRFHVGLQLENHLSLPFDKSRSHQAALVFSKHSVSTTELLKASFDKEWLLIKRNSFVYIFKTLQLIIVALVASTVFLRTHMHTRNLDDGFVYIGALLFTLIVNMFNGFAELSLAITRLPVFFKHRDLLFYPAWVFTLPNVILRIPFSIIESIVWVLVTYYTIGFSPEADRFFKHLLLVFLIQQMAGGLFRAIAGLCRSMIIAHTGGALSLLLFFVLGGFLLPKAFIPKWWIWGYWISPLMYGYNALAVNEFYSPRWMNKFVLDQNGVPKRLGIAMLEGANIFVDKNWYWIGAAGLLGFTIFFNVLFTLSLMYLNPLGKPQAIISEETAKEAEGNGHAKGTIRNGSTKSKDGSHDKEMKEMRLNARLSSSSSNGVSRVMSIGSNEAALSRGMVLPFNPLAMSFDNVNYYVDMPAEMKQQGVQDDRLQLLREVTGSFRPGVLTALMGVSGAGKTTLMDVLAGRKTGGYIEGDIRIAGYPKNQATFARISGYCEQNDIHSPQVTVRESLIYSAFLRLPEKIGDKEITDDIKIQFVDEVMELVELNNLSDAIVGLPGITGLSTEQRKRLTIAVELVANPSIIFMDEPTSGLDARAAAIVMRTVRNTVDTGRTVVCTIHQPSIDIFEAFDELLLLKRGGQVIYSGKLGRNSQKMVEYFEAIPGVPKIKDKYNPATWMLEVSSVAAEVRLKMDFAEYYKTSDLNMQNKVLVNQLSQPEPGTSDLYFPTEYSQSTVGQFKACLWKQWLTYWRSPDYNLVRFSFTLLVALLLGSIFWRIGTNMGDSTTLRMVIGSMYTAVMFVGINNCSTVQPIVSIERTVFYRERAAGMYSAMPYAIAQVVIEIPYVFVQTTYYTLIVYAMMSFQWTAAKFFWFFFISYFSFLYFTYYGMMTVSISPNHEVASIFAAAFYSLFNLFSGFFIPRPRIPRWWIWYYWICPLAWTVYGLIVTQYGDLQDPITVPGESNQTISYYITHHFGYHRDFMPVVAPVLVLFAVFFAFMYAVCIKKLNFQQR

SEQ ID NO: 8079 - protein, 1490 aa, Sorghum bicolor
MEKVWESGRRMSRSISRGMGMENWGVDDVFLPQHGGSRSRAGSRSGRGGVDDDEEALRWAAIERLPTYNRVRTAILSSSTEAADADDNSSEPLRGSHHQQQQQFKAVDVRKLGVGERQEFIERVFRVAEEDNQRFLQKLRNRLDRVGIELPTVEVRFEQLNVQAKCHVGSRALPTLLNTARNVAESALGLCGVRLGRQATLTILKDVSGVVRPSRMTLLLGPPSSGKTTLLLALAGKLDTALRRAGEVTYNGFRLDEFVPQKTAAYISQTDVHVGEMTVKETLDFSARCQGVGTKYDLMTELARREKEAGIRPEPEVDLFMKILGLDICADTIVGDQMQRGISGGQKKRVTTGEMIVGPTKVLFMDEISTGLDSSTTFQIVKCLQQIVHLGEATILMSLLQPAPETFDLFDDIILLSEGQIVYQGPREYVLEFFESCGFCCPERKGTADFLQEVTSRKDQEQYWADKRRPYRYISVPEFAQRFKRFHVGLQVENHLSLPFDKSRSHQAALVFSKHSVSTTELLKASFDKEWLLIKRNSFVYIFKTIQLIIIALVASTVFLRTHMHTRNQDDGVLYIGALLFTLIVNMFNGFAELSLAITRLPVFYKHRDLLFYPAWVFTLPNVILRIPFSIIECVAWVLVTYYTIGLAPEAERFFKHLLLVFLIQQMAGGLFRAIAGLCRSMIIAHTGGALSLLLFFVLGGFLLPKAFIPKWWIWGYWISPLMYGYNALAVNEFYAPRWMNKFVPDENGVPKRLGVAMLEGSSIFVDKNWYWIGAAGLLGFTIFFNVLFTLSLMYLNPLGKPQAVISEETAKEAEGNGHAKETIRNGSTKSKDGSHNKEMKEMRLSARLSSSSSNGVSRVMSIGSNGAAPARGMVLPFNPLAMSFDNMNYYVDMPAEMKQQGVQDDKLQLLREVTGSFRPGVLTALMGVSGAGKTTLMDVLAGRKTGGYIEGDIRIAGYPKNQATFARISGYCEQNDIHSPQVTVRESLIYSAFLRLPGQIGDQEITDDIKIQFVDEVMELVELDNLRDALVGLPGITGLSTEQRKRLTIAVELVANPSIIFMDEPTSGLDARAAAIVMRTVRNTVDTGRTVVCTIHQPSIDIFEAFDELLLLKRGGQVIYSGKLGRNSQKMVEYFEAIPGVPKIKDKYNPATWMLEVSSVAAEVRLKMDFAEYYKTSDLYKQNKVVVNQLSQPEPGTSDLYFPTEYSQSTIGQFKACLWKQWLTYWRSPDYNLVRFTFTLFVALLLGSIFWRIGTNMGDANSLRMVIGAMYTAVMFVGINNCSTVQPIVSIERTVFYRERAAGMYSAIPYALSQVVIEVPYVFVQTTYYTVIVYAMMSFQWTAAKFFWFFFVSYFSFLYFTYYGMMTVSISPNHEVAAIFAAAFYSLFNLFSGFFIPRPKIPRWWIWYYWICPLAWTVYGLIVTQYGDLQKLITVPGETDKQTISYYVTHHFGYHRDFMPVVAPVLVLFAVFFAFMYAVCIKKLNFQQR

SEQ ID NO: 8080 - protein, 757 aa, Zea mays
RILKIRRYLSIMSLQVANINAKEETPVGHGEVICFSIYSANSDVQAADFGNGKTCIWVDVLDGGRGVLMEFAPFFEDSSIKKVWHNYSFDSHVIENYGIKIAGFHADTMHLARLWDSSRKIDGGYSLEGLTNDRRVMDTVPEDLPKPGKTSMKTIFGRKNIRKDGSEGKVVSVEPVKKLQREDRELWICYSSLDSMSTLRLYDSLKSKLTTRRWILDGCPRGTMYDFYEQYWRPFGALLVKMETEGMLVDRGYLSEIEKAAIAERKLAADKFRKWASKYCPDAKYMNVNSDIQIRQLLFGGIENRHKSGETWPHSKTFKVLNEESVATEGKKTSKYRTIKLCSIVEDLKIDMFTPSGWPTVSGDALRSLAGKIPTEYIYTIDDIQDDDEYTSGSENPDGNSSYGTAYEAFGGGKNGKEACHAIAALCEICSIDSLISNFILPLQGDHISCAEGRIHCSLNINTETGRLSARTPNLQNQPALEKDRYRIRQAFVAAPGNSLIVADYGQLELRILAHLTNCKSMLHAFKAGGDFHSRTAMNMYQHIRDAVQEKKVLLEWHPQPGQEKPPVPLLKDAFGAERRKAKMLNFSIAYGKTAVGLSRDWKVSVKEARDTLKLWYRDRKEVLAWQKSQKKLASEKGEVYTLLGRSRHFPYLTQYGPGQRGHIERAAINAPVQGSAADVAMCAMLEIERNVRLKELGWRLLLQVHDEVILEGPSESAEVAKAIVVECMSKPFYGTNILNVDLAVDAKCAKSWYAAK

SEQ ID NO: 8081 - protein, 1178 aa, Sorghum bicolor
MRISFSNHGDGFRRFAGSLSLVSRAHRQQPLKPWFPFPRLPQGPNPAGLPSSAPAPATATACTPQPQVSSLHNRRLPASRRRPNALAGILPLGRAADERSPPPARSPARALAPRRQKTAAPRCGLGFCLTGAGGAARRTNLRRSVFASMVVAQVTPGPLLRRHGSAPPWLSSSSPFFLRRRASPPPAISGCRRQDYSHSSDMAVRGSSGSKLGFYPNLNVRNIAQEWVQESRRLFYLRTANNVTNNIYKGSTTLWAGNVQNELSEDRRGLNYPYLQNLRERVSSNSIVNRHGNSQELVRHRMVNQPVQSVPAPISVVNNSAKCLSMPRASKVEIPWRDYSPAEDPLLDKANTEVILELDDKVHDGDDKKEKKLVVKKVVSPLPTKAVFSEESLKARKALASIYDKVLVVDNIESARSIVKLLTTKYKSFIHACDTEVANIEAKEETPVGHGEVICFSIYSANSDVQAADFGNGKTCIWVDVLDGGRGVLMEFAPFFEDPSIKKVWHNYSFDNHVIENYGIKVAGFRADTMHLARLWDSSRKIDGGYSLEGLTNDRRVMDTVPEDLPKPGKISMKTIFGRKKVRKDGSEGKVVSIDPVKELQREDRELWICYSSLDSMSTLRLYESLKRKLETRRWVLDGCPRGTMYDFYEQYWCPFGALLVKMETEGMLVDRGYLSEIEKAAIAERELAADKFRKWASKYCPDAKYMNVNSDTQIRQLLFGGIENRHKSGETWPQSKTFKVLNEENVATEGKKTSKYRTIKLCSIVEDLKTDMFTPSGWPSASGDALRSLAGKIPTEYIYTMGDIQEDDEDSSGSENPDGDSSYGTAYEAFGGGKNGKEACHAIAALCEICSIDSLISNFILPLQGDRISCAEGRIHCSLNINTETGRLSARTPNLQNQPALEKDRYKIRQAFVAAPGNSLIVADYGQLELRILAHLTNCKSMLDAFKAGGDFHSRTAMNMYQHIRDAVHEKKVLLEWHPQPGQEKPPVPLLKDAFGAERRKAKMLNFSIAYGKTALGLSRDWKVSVKEARDTLKLWYGDRKEVLAWQKSQKKLAREKCEVYTLLGRSRHFPNLTQFGPGQRGHIERAAINAPVQGSAADVAMCAMLEIERNARLKELGWRLLLQVHDEVILEGPSESAEVAKAIVVECMSKPFHGTNILKVDLAVDAKCAKSWYAAK

SEQ ID NO: 8082 - protein, 1033 aa, Oryza sativa
MAVAPPLPPAPARQLRRWKGSSPRPPPWLSSPFRRTRYLSRPAFAAGGRQDYSPSSGMGVSKTGAFRLGLYGNLNVQSSVQEWVDETKRLFFLRTTNSVRNNITNGTTPLRVGNLRHDPSEDIRSSNYPSLYNQRERGPSNSIVNRHVDTDLAKHRVMYQSAHAVPAPFSVVNNDIKPLNMLDGSKEEIPWHDSVTMESSLPKVSKSEKTLVVDKAIPDKKEHKRITRKVTPNFPDKASLSTESKNARKLLATIYDKVLVVDNVESARSVVKLLTTKYKGFIHACDTEVANIDVKEETPVGHGEVICFSICSGNSDGEADFGNGKTCIWVDVLDGGRDVLMEFAPFFEDPFIKKVWHNYSFDIHVIENCGIKVAGFHADTMHLARLWDSSRRTDGGYSLEGLTNDYRVMDAVLKDIPKTGKVSMKTIFGRKKVRKDGSEGKTISIEPVEKLQREDRELWICYSSLDSMSTLKLYESLKNKLEAKEWIFDDCPRGTMYDFYEEYWRPFGALLVKMETEGVLVDRAYLSEIEKAAVTERELAADKFRKWASKHCPDAKYMNVNSDNQIRQLFFGGIENRNKRGETWPQSKTFKVPNDEGIATEGKKTPKSRTIKLFTIVEDLKIDMFTPTGWPSVSGDVLRSLAGKIPTDHIYKIDDGQEFDEDGSSLELPEQDIEDTSPYGTAYEAFGGGKKGREACHAIAALCEVFSIDKLISGFIVPLQGDRISCKEGRIHCSLNINTETGRLSARTPNLQNQPALEKDRYKIRHAFVAAPGNTLIVADYGQLELRILAHLTNCKSMLEAFKAGGDFHSRTAMNMYQHVRDAVEEKKVLLEWHPQPGQDKPPVPLLKDAFGAERRKAKMLNFSIAYGKTAVGLSWDWKVSVREARDTLKLWYRDRKEVSAWQKKQKAFALEKCEVYTLLGRSRQFPNMTHAGPGQKGHVERAAINAPVQGSAADVAMCAMLEIERNARLKELGWRLLLQVHDEVILEGPTESAEEAKTIVVECMSKPFYGTNILKVDLAVDAKYAKSWYAAK

SEQ ID NO: 8083 - protein, 1032 aa, Oryza sativa
MAAPAPAPAPAQLRRCPCSAPLWAAPSPFRCCGGRRGRSPFIGGGRQDYSHSSSGLGVTDNSAFKIGVYTNFNVQSNAQEWLEESKRISSIKTRNNVGNTIYKGSTHLRTGILHHEPLEDHKSSNYSSLYNVRERMTPNSLANRHANMELAKHNTRNQAASAVSALTSVVNDDIKPLNRSSGSELKTQWQPDSKTDASVLKISKVETSLQFDDKARDGYDGDEHECTAKNTVQDSPAKAPMSKESKDARKALATVYDKVLVVDNVKSARSVVQLLTSKYKNFIHACDTEVANIDVKQETPVSHGEVICFSIYSGNSDAEADFGNGKTCIWVDVLDGGRDVLMEFAPFFEDPSIRKVWHNYSFDSHVIENYGIKVAGFHADTMHLARLWDSSRRIDGGYSLEGLTNDHRVMGVVPKELQKIGKRSMKTIFGWKKIKKDGSAGKIISMEPVEVLQRDDREMWICYSSLDSMSTLRLYESLKSKLEKKHWTFDGCPRGSMYDFYEEYWRPFGALLVKMETAGMLVDRGYLSEIEKVAVAQRKLAADKFRKWASKYCPDAKYMNVNSDTQIRQLFFGGIENRCKPGETLPKSRTIKVPNDGSLIAEGKKTPKYCTIELFSIVEDLKTDLFTASGWPSVSGDALRSLAGKLPTDLVYTTDDVEDDDSGDSEISEHDLNDTASYGTAYEAFGGGKKGKEACHAIAALCEICSIDSLISNFILPLQGNHISCDEGRIHCSLNINTETGRLSARTPNLQNQPALEKDRYKIRQAFVAAPGNSLIVADYGQLELRILAHLASCKSMLDAFKAGGDFHSRTAMNMYQHIRDAVEEKKVLLEWHPQPGQEKPPVPLLKDAFGAERRKAKMLNFSIAYGKTPVGLARDWKVSVKEAKDTLKLWYRDRKEVLAWQMKQKELAQEKCEVYTLLGRSRRFPNMAHATSGQRGHIERAAINAPVQGSAADVAMCAMLEIDRNARLKELGWRLLLQVHDEVILEGPTESADLAKSIVVECMSKPFYGTNILNVELAVDAKCAQNWYAAK

SEQ ID NO: 8084 - protein, 1035 aa, Oryza sativa
MAVAPPLPPAPARLLRRWQGSSPWLSSSFGRTRYFSRPAFAAGGRQDYSPSSGMGVSKTGAFRLGLHGNLNVQSSVQEWVDETKRLFFLRTTNNVRNNITNGTTPLRVGNLRHDPSEDIRSSNYPSLYNQRERGPSNSIVNRHVDTDLAKHRVMYQSAHAVPAPFSVANNDIKPLNLLDGSKEEIPWHDSVTVESSLPKVSKSETTLVVDKAIPNKKEHKRITRKVTLNIPDKASLSTESKNARKLLATIYDKVLVVDNVESARSVVKLLTTKYKGFIHACDTEVANIDVKEETPVGHGEVICFSIYSGNSDGEADFGNGKTCIWVDVLDGGRDVLMEFAPFFEDPSIKKVWHNYSFDSHVIENCGIKVAGFHADTMHLARLWDSSRRADGGYSLEGLTNDHRIMNAVLKDIHKTGKVSMKTIFGRKNVRKNGSEGKTISIEPVKKLQREDRELWICYSSLDSMSTLKLYESLKNKLEAKEWIFDGCPRGTMYDFYEEYWRPFGALLVKMETEGMFVDRAYLSEIEKTAVVERKLAADKFRKWASKHCPDAKYMNVNSDNQIRQLFFGGIKNRNKPGETWPQSKAFKVPNDESIATEGKKIPKSRTIKLFTIVEDLKLFTTEGKKTTKTGWLKVRGDVLWSLAGKIPTDHIYKIDDDGQEFDEDGSSVELPEQDIEDTSPYGTAYEAFGGGKKGREACHAIAALCEVFSIDKLISGFIVPLQGDHISCKEGRIHCSLNINTETGRLSARTPSLQNQPALEKDRYKIRQAFVAAPGNTLIVADYGQLELRILAHLTNCKSMLEAFKAGGDFHSRTAMNMYQHVRDAVEEKKVLLEWHPQPGQDKPPVPLLKDAFGAERRKAKMLNFSIAYGKTAVGLSQDWNVEVREARDTLKLWHRDRKEISAWQKKQKALAFEKCEVYTLLGRSRQFPNMTHAGPGQKSHVERAAINAPVQGSAADVAMCAMLEIERNARLKELGWRLLLQVHDEVILEGPTESAEEAKAIVVECMSKPFYGTNILKVDLAVDAKYAKSWYAAK

SEQ ID NO: 8085 - protein, 1029 aa, Setaria italica
MAGTAPGPAPALLRRCPCSAPPWTPSPFRPRRRGRSMVSPFTGGRRQEYSQSSGVGIQDNRALKFGVCVNFNVQSSGAQEWAAESKRLSSIRTSNSTYSGSSHLGPAIIHHEHLEDFKSSNQSSPHSVRQRMAPNSLANRHASVEPAKRHMINRAAAAVSALASVVKDDTKPIKRPNESEVEAHWPNGSKFHASLPKISEVETSLPFDDKATDGNAEDENECSPKETVQPPPARAPLSQESKDARKALGTIYEKVLVVDDVKSARSVVQLLTTKYRNFFHACDTEVANIDVKQETPVGHGKVTCFSIYSGTSGAEADFGNGKTCIWVDVLDGGQDVLMEFAPFFEDSSIRKIWHNYSFDSHVIENYGIKVSGFHADTMHLARLWDSSRRLDGGYSLEGLTNDHRVMGVVPKELQKIGKRSMKTIFGRKKIKKDGSEGKITAIEPVEILQREDRELWICYSSLDSMSTLRLYESLKSKLERKPWTFDGVPRGSMYDFYEEYWRPFGAVLVKMETAGMLVDRAYLSKIEKVAVAQRKLAADKFRKWASKYCPDAKYMNVNSDTQIRQLFFGGIENRCKPGEFLPTSKAIKVPNDETAVAEGKKVPKYRTIELFSIVEDLKTDIFTASGWPSVSGDALRNLAGKVPSDLVYTTDDVNDDECGSDSEISDCDLEDTSSYGTAYEAFGGGKKGKEACHAIAALCEICSIDSLISNFILPLQGNHISCKEGRIHCSLNINTETGRLSARTPNLQNQPALEKDRYKIRQAFVAAPGNTLIVADYGQLELRILAHLADCKSMLDAFKAGGDFHSRTAMNMYQHIREAVEEERVILEWHPQPGQEKPPVPLLKDAFGAERRKAKMLNFSIAYGKTAHGLARDWKVSVKEAKDTLKLWYSDRKEVLAWQMKQKELAQEKCEVYTLLGRSRRFPNMAYATSGQRGHIERAAINAPVQGSAADVAMCAMLEIDRNTHLKELGWTLLLQVHDEVILEGPSESAELAKSIVVECMSKPFYGTNILNVDLAVDAKCAQNWYAAK

SEQ ID NO: 8086 - protein, 1029 aa, Brachypodium distachyon
MAAPPAPVPAQLRRCPCSAPLWAPSPFHHHRRLRRSPASPFIGGRRQEYSYSSGLGMTDNNALKLGVCLNFNVRSSKQEWIEESKRLYNIKTTNSVMNNVCNGAHLRAGIFHHEPFEDSKSLNQSSLYSVRERMAPNSLANRHANVELAKHHVTSHAAGAVLALTSVVNDDIKSLSRPSGSEVKIHWPNGSKVDASLPKIREVEKIMQLDDKAIDGYDGDECASKTTVQSSPVKAPLSKEAEDARKALATIYDKVLVVDTVKSARSVVQLLTTKYKSFIHACDTEVANIDVKQETPVGHGEITCFSIYCASSDAEADFGNGKKCIWVDVLDGGRDVLMEFVPFFEDPSIRKVWHNYSFDSHVIENYGIKVAGFHADTMHLARLWDSSRRTDGGYSLEGLTNDSRVMGAVPKELQNIGKRSMKTIFGRKKIKKDGTEGKITSIESVDILQREDRELWISYSSLDSMSTLRLYESLKSKLEKKHWTFDGCPRGSMYDFYEEYWRPFGAILVKMETAGMLVDRSYLSEIEKVAVAQRKLAADKFQKWASKHCPDAKYMNVNSDTQIRQLFFGGIENRCKPGEFLPKSRAIKVPNDDNTVTEGKKAPKYRTIELFSIVEDLKTDIFTASGWPSVSGDALRNLAGKLKTDLAYPMDDAEGDRYGSDSEISEDDVEDTTSYGTAYEAFGGGRKGKEACYAIAALCEICSIDSLISNFILPLQGNRISCNEGRIHCSLNINTETGRLSARAPNLQNQPALEKDRYKIRQAFVAAPGNSLIVADYGQLELRILAHLADCRSMLDAFKAGGDFHSRTAMNMYQHIRDAVEEKTVLLEWHPQPGQEKPPVPLLKDAFGAERRKAKMLNFSIAYGKTAVGLARDWKVSVKEAKDTLKLWYRDRKEVLTWQMKQRELAEEKCEVYTLLGRSRRFPNMAYASPGQRGHIERAAINAPVQGSAADVAMCAMLEIDRNTRLKELGWTLLLQVHDEVILEGPSESADVAKGIVVECMSKPFYGTNILTVDLAVDAKCAQNWYAAK

SEQ ID NO: 8087 - protein, 1029 aa, Panicum virgatum
MAGTAPAPAPALLRRCPCSAPPWAPSPFRPRRRGRSTMSPFTGGRRQEYSHSSGAGIQDNKPLKFGVCVNFNVQSSGAQEWAAESKRLSAIRTSNGTYKGSSHLGPAILHHEHLEDFKSSKQSSAHSLRQIMAPNSLANRHANMEPAKHHMINRAATAVSALASVVKDDTKPVNRHSESEVEAHWPNGSKFHASLPKISEIETSLPFDDKATESDPKDENECSPKETVQPSPAKAPLSKESKDARKALATIYEKVLVVDDVKSARRVVQLLTTKYRNFIHACDTEVANIDVKQETPVGHGKVTCFSIYSGTSGAEADFGNGKTCIWVDVLDGGRDVLMEFSPFFEDSSIRKVWHNYSFDSHVIENYGIKVSGFHADTMHLARLWDSSRRTDGGYSLEGLTNDHRVLGVVPKEVQKIGKRSMKTIFGRKKIKKDGSEGKITAIEPVEILQREDRELWICYSSLDSMSTLRLYESLKIKLERMPWTFDGVPRGSMYDFYEEYWRPFGAILVKMETAGMLVDRAYLSEIEKVAVAQRKLVAEKFRKWASKYCPDAKYMNVNSDIQIRQLFFGGIENRFKPGEFLPKSRAIKVPNDETAVAEGKKIPKYRTIELFSIVEDLQTEIFTASGWPSVSGDALRNLAGKVPSDLVYTTDDVSNDECGSDSEISDCDLEDTSSYGTAYEAFGGGKKGKEACHAIAALCEICSIDSLISNFILPLQGNHISCKEGRIHCSLNINTETGRLSARTPNLQNQPALEKDRYKIRQAFVAAPGNTLIVADYGQLELRILAHLAGCKSMLDAFKAGGDFHSRTAMNMYQHIREAVEEEKVILEWHPQPGQEKPPVPLLKDAFGAERRKAKMLNFSIAYGKTAHGLARDWKVSVKEAKDTLKLWYSDRKEVKAWQMKQKALAQERCEVYTLLGRSRRFPNMAHATSGQRGHIERAAINAPVQGSAADVAMCAMHEIDRNTRLKELGWTLLLQVHDEVILEGPAESAEQAKSIVVECMSKPFYGTNILKVDLAVDAKCAQNWYAAK

SEQ ID NO: 8088 - protein, 1033 aa, Zea mays
MAVAGLAPSPAPALLRRFPCSAPPWAPSPFRPRRPRRGRSMMSPFTGARRQEYSHSSVLGIQDNRALKLPVCVNFNLQNGGAQEWADESRRLSLSKAGNSNGSTHLGSGIFHHEPLEDFKSSNQSLLHSVRQRMAPNSLANRHVNTELAKHHAIKHAAVAVSALTSVVNDDLKSVKRPKESEVEVHWSNGPKFHSHIPKISEVETSLRFDENATDGYAKDVNECSPEETVQPSRTRAPSSQESLDARKALSTIYDKVLVVDNVMSARSVVQLLTTKYRNYIHACDTEVANINVKQETPVGHGKVTCFSIYSGTKGAEADFGNGKTCIWVDVLDGGPDVLMEFVPFFEDSSIRKVWHNYSFDSHVIENYGIKVAGFHADTMHLARLWDSSRRTDGGYSLEGLTNDHRVMGVVPKELQKIGKRSMKTIFGRKKIKKDGSEGKITAIEPVEILQREDRELWICYSSLDSMSTLRLYESLKSKLERKPWTFDGYPRPGGSLYDFYEEYWCPFGAILVKMETAGMLVDRAYLSEIEKVAVAQRESAADKFRKWASKYCPDAKYMNVNSDTQIRQLFFGGIENIYKSGDFLPKSKAIKVPNNETAVSEGKKVPKYRTIDLFSIVEDLKTDIFTASGWPSVSGAALRNLAGKVPSDLVYSTDDVNDDECGIHSEISHCDLEDTSSYGTAYDAFGGGKEGKEACHAIAALCEICSINSLISNFILPLQGNHISCKEGRIHCSLNINTETGRLSARAPNLQNQPALEKDRYKIRQAFVAAPGNTLIVADYGQLELRILAHLADCKSMLDAFKAGGDFHSRTAMNMYQHIREAVEEEKVILEWHPQPGQEKPPVPLLKDAFGAERRKAKMLNFSIAYGKTAHGLARDWKVSVKEAKDTLKLWYSDRKEVLAWQMKQKQLAHEKREVYTLLGRSRRFPNMAHATSGQRGHIERAAINAPVQGSAADVAMCAMLEIDRNTRLKELGWTLLLQVHDEVILEGPSESAELAKSIVVECMSKPFYGTNILKVDLAVDAKCAQNWYAAK

SEQ ID NO: 8089 - protein, 928 aa, Sorghum bicolor
MSDTLFVVLRKVALSLGERALERIGTEVVEAAPVLTDFEHSMKQIEAELLILQAFIGQVGAQKVDDKAFDAWLDQVRGVAHEVEDIMDEYVYHAAQAVDTGSFFKRKFRQIKNIVAWQRFASQISQVEARIQRLGEIRSRYGISVGEIDRSNKVRRPNQLFKSDSSYLTDNSEIVGNVDEIGRLTQWLLEDRQDRIVIAIFGMGGLGKTTIASSAYKNQKITRTFNCHAWVTVSQTYHVEELLREIINQLIDQRASMASGFMSMSGMKLVEVIQSYLQDKKYFIVLDDVWDKDAWLFLNYAFVRNNCGSKVLITTRRKDISSLAVDNYAIELKTLQYAESWELFCKKAFRASRDNQCPENLRFFAEKIVDKCQGLPLAIVTIGSTLSYHELEEERWAFFYNKLSWQLANNPELNWISNVLNMSLNDLPSYLRSCFLYCSLYPEDYKIRRNVISKLWIAEGFVEDRDDGTTMEDVANYYLTELTQRCLLQVIESNACGRPRTFLMHDLVREVTSIIAKKENFGIAYDNASINQVSREARRLSIQRGAQSLFSLKGHRLRSFILFDPEVPSSWIHDVLSHFRLLRVLCLRFANIEQVPGMVTELYNLRYLDFSHTKVKKIPASIRKLRNLQVLNLRFSYVEELPLEITMLTNLRHLYVSVVYDLQERSLDCFSGTKIPGNICCLKNLQALHIVSASKDLVSQLGNLTLLRSLAIMKVRQSYISELWSALTKMPNLSRLLISTFDMDEILDLKMLKPLPNLKFLWLAGKLDAGVLPSMFSKFEKLACLKMDWSGLKKDPIISFSHMLNLVDLRLYGTYHGEQLTFCAGWFPKLNSLQLVDMEHLKWIEIEDGTMISLYHLELVGLGNLKAVPTGIKYLRTLHQMFLTDMSKGFIQRLEESESVDNFIVQHIPNIHIFDSSDSQAGNFHVLC

SEQ ID NO: 8090 - protein, 451 aa, Glycine max
MNPLAIVPVQTNDAASKPGWPLLRKTIVSDRKCSQRSLLCQISVVQWAMHKSGALVPVDAEIGTAPSTEHNSRSIPKELEGLHEKYSSTCRLFKYQELVLATSNFLPENLIGKGGSSQVYRGCLPDGKELAVKILKPSDDVLKEFVLEIEIITTLNHKSLISLLGFCFEDGNLLLVYDFLSRGSLEENLHGNKKNPLMFGWTERYKVAIGVAEALEYLHNNDGQSVIHRDVKSSNVLLSEDFEPQLSDFGLAKWASTTSSHIICTDVAGTFGYMAPEYFMYGKVNDKIDVYAFGVVLLELLSGRKPISGDYPKGQESLVMWASPILNSGKVLQLLDPSLGDNYNHEEMERMVLAATLCTRRAPRARPQMSLISKLLGGDPDVIKWARLEVNALEAPEMLDDEACPPSNLQSHLNLALLDVEDDSLSMCSVEQNVSLEDYLRGRWSRSSSFD

SEQ ID NO: 8091 - protein, 651 aa, Glycine max
MKMLPSATAGDAGHGSAGDRIVVVGMKMDSHSTELLTWALFKVAQPGDVVLALHVLGNDEIVNREGKSSLFSLVKAFDSILAVYEGFCNLKQVDLKFKICRGSSVTRILVREANAYSATHIIVGSSQGLHITRPCISVARYCAKKLPKDCWVFAVDNGKIVFKREGSAATRSDLKEFIEKKRCSTSASEEEESCADACDEMNPLAIVPVQTNDAASKPGWPLLRKTIVSDRKCSQRSLLCQISVVQWAMHKSGALVPVDAEIGTAPSTEHNSRSIPKELEGLHEKYSSTCRLFKYQELVLATSNFLPENLIGKGGSSQVYRGCLPDGKELAVKILKPSDDVLKEFVLEIEIITTLNHKSLISLLGFCFEDGNLLLVYDFLSRGSLEENLHGNKKNPLMFGWTERYKVAIGVAEALEYLHNNDGQSVIHRDVKSSNVLLSEDFEPQLSDFGLAKWASTTSSHIICTDVAGTFGYMAPEYFMYGKVNDKIDVYAFGVVLLELLSGRKPISGDYPKGQESLVMWASPILNSGKVLQLLDPSLGDNYNHEEMERMVLAATLCTRRAPRARPQMSLISKLLGGDPDVIKWARLEVNALEAPEMLDDEACPPSNLQSHLNLALLDVEDDSLSMCSVEQNVSLEDYLRGRWSRSSSFD

SEQ ID NO: 8092 - protein, 869 aa, Brachypodium distachyon
MVSRSYSNLMELATGSGEEPLPSLGRRRIPRVVTASGIVPDLDCSDDDAASAASDHSSSHAPRERTIIVANQLPIRASRRAGGGGWEFSWDEDSLLRQLKDSLRAHQGRADMDFVYVGCLREDIPAADQDQVAHELFEGFRCVPTFIPADLRSRFYHGFCKQQLWPLFHYMLPLSPELGGRFDRVLWQAYVSVNKIFADKILEVISPDEDFVWVHDYHLMVLPTFLRKRFNRVRLGFFLHSPFPSSEIYKTLPVREELLRALLNADLIGFHTFDYARHFLSCCSRMLGLKYESQRGYIALEYYGRTVTIKILPVGIHLTQLQSVLNLPETGVKVAELLKQFCDRGRLLMLGVDDMDIFKGISLKLLAFEQLLMQHPEWRGKVVLVQIANPARGRGKDVQEVQDESYAMVRRINEAFGQPDYQPVILIDRPLQFYERMAYYVVAECCLVTAVRDGMNLIPYEYIIARQGNEKIDRILGLSPSTRKKSMLVVSEFIGCSPSLSGAIRVNPWNIDSVADAMDSALEIPEGEKVLRHEKHHKYVSTHDVGYWANSFLQDLERTCLDHNKRRCWGIGFGLKFRVVALDTSFKKLAVEQLVSAYRRTTTRAILLDYDGTLMPQTSFGKNPSSKTMDMLNSLCRDKNNMVLLASTKTRATLNEWFSPCENLGLAAEHGYFLRMRRDAEWEICAPATDCSWKQIVEPVMKTYTETTDGSTIEDKETAIVWCYEDADPDFGSCQAKELHDHLESVLSNEPVSVKADLNHVEVKPQGVNKGLVAKRMLSTMQEQGLLPDFILCIGDDRSDEDMFEVITTAIDGPCLNPDAEVFACTVGRKPSKAKYYLDDPADIVRLIQALANVSNQAQSSTPPSSASD

SEQ ID NO: 8093 - protein, 650 aa, Hordeum vulgare
RVPRVVTASGIVPGLHCFDDDAGTASVASDQPNQAPRERTIIVANQLPIRATRGADGAWEFSWDEDSLLRQLKESMRGHQGRVDMDFVYIGSLRDDIPAEEQEKVAAELYDRFRCVPAFLAADLRSRFYHGFCKQQLWPLFHYMLPLSPELGGRFDRTLWQAYVSVNKIFADKILEVINPEEDFVWVHDYHLMVLPTFLRKRFNRVRLGFFLHSPFPSSEIYKTLPVREELLRALLNADLIGFHTFDYARHFLSCCSRMLGLKYESQRGYIALDYYGRTVTIKILPVGIHLVQLQSVLNLPETGLKVAELMKQFCGRGRILMLGVDDMDIFKGISLKLLAFEQLLVQHPEWRGKLVLVQIANPARGRGKDVKDVQDESYAMVRRINEAFGQPDYQPVILIDRPLHFYERMAYYVVAECCLVTAVRDGMNLIPYEYIIARQGNDKIDRILGLSPSTKKKSMLVVSEFIGCSPSLSGAIRVNPWNIDSVTEAMEKALSISDCEKVLRHEKHHKFVSTHDVGYWANSFLQDLLRSCQDHNKRRCWGIGFGLRFRVVALDTSFKKLAAEQLVSAYRKATTRAILLDYDGTLMPQTSFGKNPGSKTIDMLNSLCRDEKNMVLIASTKTRATLSEWFSPCEDLGLAAEHGYFCCVG

SEQ ID NO: 8094 - protein, 874 aa, Panicum virgatum
MVSRSYSNLLELASGGGGGGEPLPSLGRRRVPRVVTAPGIVPGLDASDDDDDADAASDRSSHAPRERVIIVANQLPVRAAHRAGGAGWDFAWDEDSLLLQVKDSLRAHHGRGDVEFVYVGGLRDDVPPADHDHVAHHLLEGFRCVPTFLPADLRSRFYHGFCKQQLWPLFHYMLPLSPELGGRFDRLLWQAYVSVNKIFADKILEVISPDEDFVWVHDYHLMVLPTFLRKRFNRVKLGFFLHSPFPSSEIYKTLPVREELLRSLLNADLIGFHTFDYARHFLSCCSRMLGLKYESQRGYIALEYYGRTVTIKILPVGVHLEQLQSVLNLPETGVKVAELLKQFNHRSRLLLLGVDDMDIFKGISLKLLAFEQLLMQHPKWRGRVVLVQIANPARGKGKDVKEVQEESDAMVKRINDAFGQPDYQPVILIDKPLRFYERMAYYVVAECCLVTAVRDGMNLIPYEYIIARQGNEMIDRILGLGPSSRKKSMLVVSEFIGCSPSLSGAIRVNPWNIDSVADAMDSALEMPEGEKVLRHEKHHRYVSTHDVGYWANSFLQDLERTCLDHNRRRCWGIGFGLKFRVVALDPNFKKLAVEHLVSAYRRTTKRIILLDYDGTLMPQTSFGKSPTSRTIDMLNSLCRDKNNMVFLVSTKSRTTLSEWFSPCENLGLAAEHGYFLRLRRDAEWEECVTVIDCSWKQIAEPVMKTYTETTDGSTIEDKETAIVWSYEDADPDFGSCQAKELHDHLESVLSNEPVSVKAGLNHVEVKPQGVSKGLVAKRILSTMQERGDLPDFILCVGDDRSDEDMFEVITTAAARGPSSLHPEAEVFACTVGRKPSKAKYYLDDPADIVRLIQGLANVSNDQASHGGSGATLPD

SEQ ID NO: 8095 - protein, 885 aa, Oryza sativa
MVSRSYSNLLELAAGGGGGGGGEGPLPSLGRRRIPRVVTASGIVPDLDYSDDDAASAASSSDHSSAHSHAPRERAIIVANQLPIRASRRGGGGGGWEFSWDEDSLLLQLRDSLRAHADRADDMEFVYVGGLRDDVPAAEHDEVAHHLLEGFRCVPTFLPADLRSRFYHGFCKQQLWPLFHYMLPLSPELGGRFDRALWQAYVSVNKIFADKILEVISPDEDYVWVHDYHLMILPTFLRKRFNRVKLGFFLHSPFPSSEIYKTLPVREELLRSLLNADLIGFHTFDYARHFLSCCGRMLGLKYESQRGYIALEYYGRTVTIKILPVGVHLEQLRSVLNLPETGVKVAELLKQFCDQNRLMLLGVDDMDIFKGISLKLLAFEQLLMQHPEWRGRVVLVQIANPARGRGKDVKEVQDESYAMVRRINEAFGQPGYQPVILIDRPLQFYERMAYYVVAECCLVTAVRDGMNLIPYEYVIARQGNEKLDGILGLGPSARKKSMLVVSEFIGCSPSLSGAIRVNPWNIDAVADAMDSALEMPEGEKVLRHEKHHKYVSTHDVGYWANSFLQDLERTCLDHSRRRCWGIGFGLRFRVVALDPNFKKLAVEHLVSAYRRTTTRIILLDYDGTLMPQTSFGKSPSSKTIDMLNSLSRDQNNMVFLVSTKKRSTLEEWFSSCDNLGLAAEHGYFLRLKRDAEWETCVPVTDRSWKQIAEPVMKTYTETTDGSTIEDKETAIVWSYEDADPDFGSCQAKELHDHLESVLANEPVTVKAGLNHVEVKPQGVSKGLVAKRLLSIIRENSLLPDFVLCIGDDRSDEDMFEVITTAAQDNCLSPDAEVFACTVGRKPSKAKYYLDDLADIVRLIQGLANVSDEMHSTMPTPVDAADTALR

SEQ ID NO: 8096 - protein, 353 aa, Triticum aestivum
MPDLVRDHLYFGGINDAIAALTASLPDGTDITHVLSVVSSASISFFTDYRPGLSLPAEEVRRVVAGEDGAPSAVAPGRLMRVVERTGEGLRVTRMAVPLRDTEEENLLDHLEPCLDFIDEGRKAGNVLVHCFAGVSRSATIITAYLMRTEQKSLDEALESLKEINESVCPNDGFLDQLKLFEEMGFKVDTSSPLYRRFRLKLLGQSYKVGEKIGNHVFEDDPGVARQPNPNQELSGKEKTLKTAYRCKKCRRIVAAQDNVIGHTPGEGNSSFAWHDKRKGHTHNKEQDCSSLYVEPLKWMTPVEDGALEGKLSCIHCGARLGYFNWSGIQCNCGSWITPAFQISKSKVDVSTI

SEQ ID NO: 8097 - protein, 352 aa, Secale cereale
MPDLVRDHLYFGGINDAIAALTASLPDGTDITHVLSVVSSTSISFFTDYRPGLSLPAEEVRRVVAGEDGTPSALAPGRLMRVVERTGEGLRVTRMAVPLKDTEEENLLDHLEPCLDFIDEGRKAGSVLVHCFAGVSRSATIITAYLMRTEQKSLEALESLKEINESVCPNDGFLDQLKLFEEMGFKVDTSSPLYRRFRLKLLGQSYKVGEKIGDHVFEDDPGVARQPNPNLESSGKEKTLKTAYRCKKCRRIVAAQDNVIGHTPGEGNSSFAWHDKRKGHTYNKEQDCSSLYVEPLKWMTPVEDGALEGKLSCIHCGARLGYFNWSGIQCNCGSWITPAFQISKSKVDVSTI

SEQ ID NO: 8098 - protein, 1801 aa, Triticum aestivum
MGSPEGRLVELLGAVKSRMPRRGEHSPPPAPKAAAAADVPQAQPHDLSRDFWMPDQSCRVCYDCDAQFTILNRRHHCRHCGRVFCARCTANSVPRSLGDAAREDIERIRVCNYCFKRWLEEEAATRRDVAQPSSPSPSATSAGSEKSCSTGRSSTVTNGQLLSYANVSCTDSASRSVGSEGNCGELDASLELQHAVMEPDGAMEHAAYVDNSPDPFNFCLNRSDDEDDDYTIFRSDSEVHHLQNSDEYNGPMCFDDHQVICNDAAKDSASPRKDTATLVNSEGMDKTGDHIIDNAEECNARSSSLYGMEVLENELVDFENNSSLWLPPEAEDEEDDHDGAPCDDDEGEDATGEWGYLRSNSFSSGHCRSRDKSAEEHKKAMKDIVDGHFRALVAQLLQAEKIELGDKIGNESWLDIVTSLSWEAASLLRPDTSKGGRMDPGGYVKVKCLACGRPSDSLVVRGVVCKKNVAHRRMSTKKEKPRILILGGALEYQRVSNLLSSFDTLLQQETDYLKMAVVKIKAHQPSVVLVEKSVSRYAQDLFLEKNISLVLNIKRPLLERISRCTGAQIVPSIDYLSSQKLGNCDLFHVEKYIEEHGTAGEGGKKMLKTLMFFEGCPKPLGFTILLKGANGDELKKVKHVVQYGVFAAYHLALETSFLVDEGATLPELPLKSPIIVALPDKPSSADRSISTIPILQMPTISSPNNNLQAFDIQKDDFTFNGFRMMDQMAAASFPDNKCWERLGVGSTQASSVQINDQTGDIGCLLGMDPQSYNDPLVQQSRISFCQCPACTRDVGSKMKFEELQPETNVLSVLSAHPANLVAAESDLSFAHNANNGAKVAAKPSAPLNLQVSYNNGGSNDGSIVKRDEIPASPADNQSILVSLSSRCVWKEAICERPHLLRIKYYGNFDKPLGRFLRDQLFDQSNCCLSCELAPEAHVYCYVHPQGSLTISVRKLIVKLPGEHDGKIWMWHRCLRCPRDKGLPPATKRVVMSDAAWGLSFGKFLELSFSNHAAASRVASCGHSLHRDCLRFYGFGEMVACFRYASIKVHSVYLPPSKLDFTSQHQEWVEQEANEVVDSAELLFTEVLNALHQISEKRPITGSFDGNMKILELRQNIVELEDILQAEKVDFTESLKNLLKKEIRKGQLFIDILEVNKLRRQLLFLCYLWDQRLSFIATSGGKYCAALGSLRVGSNNSEINDRSADTNTNTKLEKNSKGTDSNALHAGDEGTNQHDQSNETCSRNTEELNGAEDTIVEINHANSANVRDHLDHQGSIIGVRRVSSEGQFPVATDISDKLDAKWRGEDGPAPDASLVKPLALLEGTAADVKKQAKAVPRHTSASVRSGDTVEDLLSCLKMPYMTFYNSLNTNSGTAPTFGTLADYNPVYISLFRDLSQQGGARLFLPTGANDVVIPVFDDEPTSIISYALVSPVYHFQMSVESNQNKDSADSTLSLPVYDSGNFNLFHLFEDFGSSDDFAASISSSRGSFAPDLLHSRVSFQDGGPLGKVKYTVTCYYAKSFEELRRSCCPSELDYLRSISRCKKWGAQGGKSNVFFAKSLDDRFIIKQVTKTELESFLQFGPDYFKYLSESISTGSPTCLAKILGIYQVTIKHLKGGKESKMDLLVMENLLFGRNITRLYDLKGSSRSRYNADSSRNKVLLDQNLIEAMPTSPIFVGNKAKRLLERAVWNDTSFLAGIDVMDYSLLVGVDEEKHELVLGIIDFMRQYTWDKHLETWVKSSGILGGPKNAAPTVVSPMQYKKRFRKAMSAYFIVIPEQWMPAIINPDQSSSNICEDDSQNASPE

SEQ ID NO: 8099 - protein, 1469 aa, Secale cereale
MGSPEGRLVELLGAVKSRMPRRGEHSPPPAPKAAAAADVPPAQPHDLSRDFWMPDQSCRVCYDCDAQFTILNRRHHCRHCGRVFCARCTANSVPRSLGDAAGEDIERIRVCNYCFKRWLEEEAAARRDVAQSSSPSPSATSAGSEKSCSTGRSSTVTNGQLLSYANASCTDSASRSVGSEGNCGRLDASLELQHAVMEPDGSVEHAAYVDNSPDPFNFCSNRSDDEDDDYTIFCSDSEVHHLQNSDEYNGLMCFDDHQVVCSDAAKDSASPRKDTATLVNSEGMDKTGDHIIDNAEECNARSSSLYGMEVLENELVDFENNSSLWLPPEAEDEEDDHDGAPCDDDEGEDATGEWGYLRSNSFSSGHCRSRDKSAEEHKKAMKDIVDGHFRALVAQLLQAEKIELGDKIGNESWLDIVTSLSWEAASLLRPDTSKGGRMDPGGYVKVKCLACGRPSDSLVVRGVVCKKNVAHRRMSTKKEKPRILILGGALEYQRVSNLLSSFDTLLQQETDYLKMAVVKIKVHQPSVVLVEKSVSRYAQDLFLEKNISLVLNIKRPLLERISRCTGAQIVPSIDYLSSQKLGNCDLFHVEKYIEEHGTAGEGGKKMLKTLMFFEGCPKPLGFTILLKGANGDELKKVKHVVQYGVFAAYHLALETSFLVDEGATLPELPLKSPIIVALPDKPSSADRSISMIPILQMPTISSPSNNLQAFDIQKDDFTFNGFRMMDQMAAASFPDNKCWERLGVGSSSTQASSVQINDQTGNIGCLLGMDPQSYNDPLVQQSRISFCHCPACTRDVGSKMKFEELQPETNRHPMANGLSVLPAHPANLAAAESDLSFAHNANNGAKVAAKPSAPLNLQVSYNNGSSNDGSIVKRDEIPASPADNQSILVSLSSRCVWKEAICERPHLLRIKYYGNFDKPLGRFLRDQLFDQSNCCLSCELAPEAHVYCYVHPQGSLTISVRKLIVKLPGEHDGKIWMWHRCLRCPRDKGLPPATKRVVMSDAAWGLSFGKFLELSFSNHAAASRVASCGHSIHRDCLRFYGFGEMVACFRYASIKVHSVYLPPSKLDFTSQHQEWVEQEANEVVDSAELLFTEVLNALHQISEKRPITGSFDGNMKILELRQNIVELEDILQAEKVDFTESLKNLLKKEIRKGQLFIDILEVNKLRRQLLFLCYLWDQRLSFIATSGGKYCDALGGLRVGSNNSEINDRLADTNTNTKLEKNSKGTDSNALHAGDEGINQHDQSNETSSRNTEELNGAEDTIVKINQANSANVRDHLDHQGSIIGVRRVSSEGQFPVATDISDKLDAKWRGEDGPAPDASLVKPRALLEGTAADVKKQAKAVPRHTSASVRSGDTVEDLLSCLKMPYMTFYNSLNTNSGTAPTFGTLADYNPVYISLFRDLSQQGGARLFLPTGANDVVIPVFDDEPTSIISYALVSPVYHFQMSVESNQNKDTADSTLSLPVYDSGNF

SEQ ID NO: 8100 - protein, 1817 aa, Brachypodium distachyon
MGSPEGRIVDLFGAVKLWMPRRGERSPSPAPKAAAAAAADDVPQPHDLSRDFWMPDHSCRVCYDCDTQFTILNRRHHCRHCGRVFCARCTANSVPRPPGDDPREDGERIRVCNYCFKRWLEEETAGWSEVAQPPSPSPSAASVGSDKSCSTGRSSVVTNGHMSSYANVSCGDFASLPADDEGDCDQPGVSPEKKHDVMEPAGSVDHVADVDNASNPFTFCLNRSDDEDEDYTIFRSDSKVHPQKSDEYYGPMCFDDHQVVCGDAAKESVSPRKDTSTLVDSVGVDKTGDHIIDNNEEGNARSSSLYGMEVLESELVDFENNSSLWLPPEAEDEEDDHDGALCDDDEGEDATGEWGYMRSNSFGSGHCRSRDKSAEEHKKAMKDIVDGYFRALVSQLLQAEKVPLVDETGKESWLDIVTSLSWEAASLLKPDTSKGGRMDPGGYVKVKCLACGRPSDSLVVRGVVCKKNVAHRRMSSKKEKPRILILGGALEYQRVSNLLSSFDTLLQQETDYLKMAVAKIKAHQPSVVLVEKSVSRYAQDLFLEKNISLVLNIKRPLLERISRCTGSHIVPSIDYLSSQKLGNCDLFHVEKYIEEHGTAGEGGKKMLKTLMFFEGCPKPLGFTILLKGANGDELKKVKHVVQYGVFAAYHLALETSFLVDEGATLPELPLKSPIIVALPDKPSSADRSISTIPILQMPTASSPNNDLQALNTQKDNFPFNGFRIMDQTAAACSPDNKSCERSRVSSIQTSSVQINKNENNCLLGMVPQSYIDPLLQQSRISFCHCPTCTRDVGSELKFEELQPESTRHALVKGFGVSPAPPANLVSAEHDFSFAHNSENGVKISDKSSAPLELQTSHDDDSSKDCSIVKKDEVPASPVDNQSILVSMSSRCVWKEAVCERPHLLRIKYYSNSDKPLGRFLRDQLFDQTNRCISCELAPDAHVYCYVHPQGSLTISVRKLIVKLPGEHDGRIWMWHRCLRCPRNDGLPPATKRVVMSDAAWGLSFGKFLELSFSNHAAASRVASCGHSLHRDCLRFYGFGEMVACFRYASIMVHSVYLPPSKLDFTSQHQEWVEQEANEVVDSAELLFTEVLNALHQISEKRPITGSLDGNMKILELRRNIVELEDILQEEKADFTESLKNLLKKEIRKGQLFIDILEVNKLRRRLLFLCYLWDQRLSFIATSGGKYCDALGGLQVGSRNSESSDRPADINAKLEKNPKVTELLLNAKNGSLRQSLSTPHADREELNQHDQSNETSLRNIAELNCTEDTVFKINHANSANVKDHLDHQESGIGVRRISSEGQFPVTADISDTLDAKWRGENGPAPDASMVKPLALPGGTAPDVKNHVKAVRCHTSALSVKTGDTVEDLLSCLKLPYMTLYNSLNTNSGTAPTFGTLADYSPEYISLFRELSQQGGARLFVPTGANDVVIPVFDDEPTSIIAYALVSPMYYLQMSVENSKTKDSADSSLSLPVYDSGNFNPFLLFEDFGSPDDLASSISASRGSLAPDLVHSRVSFEDGGPLGKVKYTVTCYYAKSFEALRRSCCPSELDFVRSVSRCKKWGAQGGKSNVFFAKSLDDRFIIKQVTKTELESFLQFGPEYFKYLSESISTGSPTCLAKILGIYQVTSKHLKGGKESKMDLLVMENLLFGRNITRLYDLKGSSRSRYNADSSNNKVLLDQNLIEAMPKSPIFVGNKAKRLLERAVWNDTSFLAGIDVMDYSLLVGVDQEKHELVLGIIDFMRQYTWDKHLETWVKSSGILGGPKNAAPTVVSPMQYKKRFRKAMSAYFIVIPDQWMPAVINPDRSSSDICQDDSQNTSQE

SEQ ID NO: 8101 - protein, 1830 aa, Oryza sativa
MGSPEGRLVELFGAVKSWMPRRGDHSPPPPLPPPPASQVGAGGGGGAASPQPHDLSRDFWMPDQSCRVCYDCDAQFTILNRRHHCRHCGRVFCARCTANSVPRAPGDAAREDGERIRVCNYCFRRWLEEEAAARRDVAQPSSPVLSPSASAVSIGSDKSSSTARSSAGTNGQMSSYTNVSYTDFPSMAVEGQGECCEREGCAEKQLPAMEPAGGVEPATYVDNTSDPYNFGINRSDDEDDDYAVFHSDSKTQHLQNSDEYFKTVCFDAHQVDCSHVKESVSPMQDTENFIGSVGVDKTGDHIMDNTEECNTRSSSLYSMEMLENEPVDFENNSSLWLPPEPEDEEDDHDGALCDEDDGEDATGEWGYLRSNSFGSGHCRSRDKSAEEHKRAMKDIVDGHFRALVAQLLQAEKVQLVDKSGKQSWLDIVTSLSWEAASILKPDTSKGGRMDPGGYVKVKCLACGRPSDSFVVKGVVCKKNVAHRRMASRKEKPRILILGGALEYQRISNLLSSFDTLLQQETDYLKMAVAKIKAHQPSVVLVEKSVSRYAQDLFLEKNISLVLNIKRPLLERISRCTGAHIVPSIDYVSSQKLGHCDLFHVEKYVEEHGTAGEGGKKMLKTLMFFEGCPKPLGCTILLKGANGDELKKVKHVVQYGVFAAYHLALETSFLVDEGATLPELPLKSPIIVALPDKPSSADRSISTIPILQMPTASSPNDSLQAFDVQTDGSTFNGFQTMDQTMVMCSPEYKSCKKLGAGSAQTESAHFNGQDKNIACLHGMVPWSSTDPLVQQSASSLCHCPSCSRDVVNKKHFEERQPETSGHTLDNDFNALSAHRTNLESVESGHLFAYNSENGDKIRAKLSVPLNVQISLDDDSSKDDSVIKKDEIPASPADNQSILVSLSSRCVWKETVCQRPHLLRIKYYGNFDKPLGRFLRDQLFDQNNNCISCELPPEAHVYCYVHPQGSLTISVRKLAVKLPGEHDGKIWMWHRCLRCPRVIGLPPATKRVVMSDAAWGLSFGKFLELSFSNHAAASRVASCGHSLHRDCLRFYGFGEMVACFRYASIKVHSVYLPPPKLDFTSQHQEWVEQEANEVVDSAELLFTEVLNALHQISEGRPITGSFDGNMKILELRRNIMELEEILQIEKADFTESLKNLLNKEIRKGKPFIDILEVNKLRRQLLFLCYLWDQRLIFIANSGGKYCDTLGGLRVGSRSSDSNDKSVDTNATTKLEKSSKGSEVLSNAKEGSLKQSQSPLHANDKEPNQPDQSNGNSSRIGAGLNGMEDAIAKINHSNSADVKDNLDHQESSIGVRRVLSDGQFPVNADISDTLDAKWRGENGTVPDTSILKPLALLEGSADLKNQAKAVPTNASLSVRSGDTVEDLSSWLKMPYMTFYDSLNTNSGTAPRFGALADYNPVYITLFRELSQQGGARLFLPTGANDVVIPVFDDEPTSIISYALVSPMYCHQMLDENSKNKDGPDSSLPLPVYDSGNFNPFHLFEDFGSADDLASSISGTRGSFVPDLVHLRVPFEDGGPLGKVKYTVTCYYAKSFEALRRSCCPSELDFLRSISRCKKWGAQGGKSNVFFAKSLDDRFIIKQVTKTELESFLKFGLDYFKYLSESISTGSPTSLAKILGIYQVTIKHVKGGKESKMDLLVMENLLFGRNITRLYDLKGSSRSRYNADSSSNKVLLDQNLIEAMPTSPIFVGNKAKRLLERAVWNDTSFLAGIDVMDYSLLVGVDEEKHELVLGIIDFMRQYTWDKHLETWVKSSGILGGPKNAPPTVISPMQYKKRFRKAMSAYFIVIPEQWMPAIINPSKSSSNLCQEDPQNASQE

SEQ ID NO: 8102 - protein, 260 aa, Triticum aestivum
MSSAGSARVPKRRRTTKTSEAADRQLRERQFLDLNLFPAVEVARTGGSLSINEPVSHRQPPPTVAALLYETTQVVVSSAAAESNIGMNSFPINVEVIDDDVAIYTSGPPPQARQQSSRTGPITVIIDDDSETTAGPAGEALDEHVNTLLSLGMNPRHNPSRAQPNTDLVINIVDTPETNNIPPKVVQAVPEPVKEIPKETKFSCPVCMNELVNASSTICGHIFCQKCIKASIQAQKKCPTCRRKLTMSNFHRVYLPTADN

SEQ ID NO: 8103 - protein, 260 aa, Secale cereale
MSSAGSARVPKRRRTTKTSEAADRQLRERQFLDLNLFPAVDVASTGGSLSINEPVSRTQPPPTVAALLYETTQVVVSSAAAGSNIGLNSFPINVEVIDDDVAIYTSGPPPQARQQSSRTGPITVIIDDDSETTAGPAGEALDEHVNTLLSLGMNPRHNPSRAPPNTDLVINIVDTPETNNLPPKVVEAVPEPVKEIPKETKFSCPVCMNELVNASSTICGHIFCQKCIKASIQAQKKCPTCRRKLTMSNFHRVYLPMADN

SEQ ID NO: 8104 - protein, 260 aa, Pseudoroegneria spicata
  misc_feature (159)..(159): Xaa can be any naturally occurring amino acid
MSSAGSARIPKRRRTTKTSEAADRQLQERQFLDLNSLPGVEGVSIGGSLSINERVSHSQPPPTVVELVYETTQFVVSSAAAGSNIGMNSFPINVEVIDDDVAIYTSGPPPQARQQSSRTGPITVIIDDDSETTAGPAGEALDEHVNTLLSLGMNPRHNXSRAQPSTDLVINIVDAPETNNIPPKVAQAVPEPVKEIPKEPKFSCPVCMNELVNASSTICGHIFCQKCIKASIQAQKKCPTCRRKLTMSNFHRVYLPTAEN

SEQ ID NO: 8105 - protein, 589 aa, Triticum aestivum
MEPSTGFRASVWSCFKFLPFFCGLLLLGIIKGVLFGPWAWLIMAIGISALVLGLWPMHLIWTYYCIIRTKLVGPVVKLLLLISVSGILVLWLIVGILGSVLAGLAYGFLAPVMATFDALGEGKERPLVHCFVDGTWSTITGGCTVVRDLKDMLFHSYLAYMDDLRYHEPPGGKPFEIRVLDIPGAVLAAACGLLMDGIMFTAIALYKFPVMLFKGWKRLIEDLVGREGPFLETVCVPFAGLAILLWPFAVLGAFLASMISSVPLGAYAAIVVYQESSLFMGLSYAISSVSIFDEYTNDVLDMAPGSCFPRFVYRKNQASVESVRGPLSRPASFRDKQDGKKAPARITSFKSSFDEFNPFKLLDHLFEECQHRGEALVAEGVITPKDIEETKSGKGGSGVLNVGLPAYVILNALLRSAKADSDGLILRDGCEITSDNRPKNTLFDWFFDPLMVIKDQIKAENFTEEEEAYLQKRVLLISDPKRLKATLPHLPSLNERKQAEIDAFARRLQGITKSISRYPTSKRRFDDLVKALSEELERAMGGSRSVSGSQFQKLRSGLVRMLSQRSMGKTASIRGGDQEAQLTSDTRAA

SEQ ID NO: 8106 - protein, 589 aa, Triticum aestivum
MEPSTGFRASVWSCFKFLPFFCGLLLLGIIKGVLFGPWAWLIMAIGISALVLGLWPVHVIWTYYCIIRTKLVGPVVKLLLLISVSGILVLWLIVGILGSVLAGLAYGFLAPVMATFDALGEGKERPLVHCFVDGTWSTITGGCTVVRDLKDMLFHSYLAYMDDLRFHEPPGGKPFEIRVLDIPGAVLAAACGLLMDGIMFTAIALYKFPVMLFKGWKRLIEDLVGREGPFLETVCVPFAGLAILLWPFAVLGAFLASMISSVPLGAYAAIVVYQESSLFMGLSYAISSVSIFDEYTNDVLDMAPGSCFPRFVYRKNQASMESGRGPLSRPASFRDKQDGKKAPARITSFKSSFDEFNPFKLLDHLFEECQHRGEALVAEGVITPKDIEETKSGKGGSGVLNVGLPAYVILNALLRSAKADSDGLILRDGCEITSDNRPKNTLFDWFFDPLMVIKDQIKAENFTEEEEAYLQKCVLLISDPKRLKATLPHLPSLNERKQAEIDAFARRLQGITKSISRYPTSKRRFDDLVKALSEELERAMGGSRSVSGSQFQKLRSGLVRMLSQRSMGKTASIRGGDQEAQLTNDAGAA

SEQ ID NO: 8107 - protein, 117 aa, Triticum aestivum
MEPSTGFRASVWSCFKFLPFFCGLLLLGIIKGVLFGPWAWLIMAIGISALVLGLWPVHVIWTYYCIIRQNQAGGTCCEAAASYFCIWDFSLVADSWHPWKCTCWVSIRLSSTSNGHI

SEQ ID NO: 8108 - protein, 589 aa, Triticum aestivum
MEPSAGFRASVWSCFKFLPFFCGLLLLGIIKGVLFGPWAWLIIAIGISALVLGLWPMHVIWTYYCIIRTKLVGPVVKLLLLISVSGILVLWLIVGIVGSVLAGLAYGFLAPVMATFDALGEGKKRPLVHCFVDGTWSTITGGCTVVRDLKDMLFHSYLAYMDDLRYHEPPGGKPFEIRVLDIPGAVLAAACGLLMDGIMFTAIALYKFPVMLFKGWKRLIEDLVGREGPFLETACVPFAGLAILLWPFAVLGAFLASMISSVPLGAYAAIVVYQESSLFMGLSYAISSVSIFDEYTNDVLDMAPGSCFPRFVYQKNEASVESTRGPLSRPASFRDKQDGKKAPARVTSFKSSFDEFNPFKLLDHLFEECHHRGEALVAEGVITPKDIEETKSGKGGSGVLNVGLPAYVILNALLRSAKADSDGLILRDGCEITSDNRPKNTLFDWFFDPLMVIKDQIKAENFTEEEEAYLQKRVLLISDPKRLKATLPHLSSLNERKQAEIDAFARRLQGITKSISRYPTFKRRFDDLVKALSEELERAMGGSRSVSGSQFQKLRSGLVRMLSQRSMGKTASIRGGDQEAQLTNDAGVA

SEQ ID NO: 8109 - protein, 562 aa, Triticum aestivum
MEPSAGFRASVWSCFKFLPFFCGLLLLGIIKGVLFGPWAWLIMAIGISALVLGLWPMHVIWTYYCIIRTKLVGPVVKLLLLISVSGILVLWLIVGIVGSVLAGLAYGFLAPVMATFDALGEGKKRPLVHCFVDGTWSTITGGCTVVRDLKDMLFHSYLAYMDDLRFHEPPGGKPFEIRVLDIPGAVLAAACGLLMDGIMFTAIALYKFPVMLFKGWKRLIEDLVGREGPFLETVCVPFAGLAILLWPFAVLGAFLASMISSVPLGAYAAIVVYQESSLFMGLSYAISSVSIFDEYTNDVLDMAPGSCFPRFVYRKNQASMESGRGPLSRPASFRDKQDGKKAPARITSFKSSFDEFNPFKLLDHLFEECQHRGEALVAEGVITPKDIEETKSGKGGSGVLNVGLPAYVILNALLRSAKADSDGLILRDGCEITSDNRPKNTLFDWFFDPLMVIKDQIKAENFTEEEEAYLQKCVLLISDPKRLKATLPHLPSLNERKQAEIDAFARRLQGITKSISRYPTSKRRFDDLVKALSEELERASGRQPICQWITSSEAQKRSCSNA

SEQ ID NO: 8110 - protein, 432 aa, Triticum aestivum
MEPSAGFRASVWSCFKFLPFFCGLLLLGIIKGVLFGPWAWLIIAIGISALVLGLWPMHVIWTYYCIIRTKLVGPVVKLLLLISVSGILVLWLIVGIVGSVLAGLAYGFLAPVMATFDALGEGKRPLVHCFVDGTWSTITGGCTVVRDLKDMLFHSYLAYMDDLRFHEPPGGKPFEIRVLDIPGAVLAAACGLLMDGIMFTAIALYKFPVMLFKGWKRLIEDLVGREGPFLETACVPFAGLAILLWPFAVLGAFLASMISSVPLGAYAAIVVYQESSLFMGLSYAISSVSIFDEYTNDVLDMAPGSCFPRFVYQKNEASVESTRGPLSRPASFRDKQDGKKAPARITSFKSSFDEFNPFKLLDHLFEECQHRGEALVAEGVITPKDIEETKSGKGGSGVLCGLPAYVILNALQRSAKADSDGLILRDGCEITI

SEQ ID NO: 8111 - protein, 585 aa, Oryza sativa
MEPPSGIRASAWSFFKFLPFFLGLLLLGIIKGALLFPWAWLIMMIGISALVLGLWPMHVIWTYYCIIRSKLVGPVVKLLLLVAASVILVLWLIVGIVGSVLIGVVYGFLAPVMATFDAVGEGKERPLYHCFVDGTWSTITGSCTVVRDLKDLLLHSYFSIMDDLRFHAPPGGEPYEIRVLDIPGALFAAACGFLVDGIMFTLIAFYKFPVMLFKGWKRLIEDLVGREGPFLETACVPFAGLAILLWPFAVFGAFLASIISSIPLGAFAAVVVYQESSLIMGLNYVISSVAIFDEYTNDVLDMAPGSCFPRFKYRKNEASTEGGSLSRPASFKDKQDGKKAPSRVTSFKGSFDEFNPFKLLDHLFEECKHRGEVLVAEGVITPKDIEETKSGKIGIGVLNVGLPAYVILHALIRSAKANSDGLILSDGSEITSDNRPKNTIFDWFFDPLMVIKEQIKAQNFTEEEEAYLKKRVLLTSDPKRLKEVVPHLPSSLNERKQAEIDALSRRLQGITRSISRYPTAKRRFDDLVRSLSEELERTMGGSQSGSVSQMQKLRSGISRMLSQRSMGKRTSNRGDDREAQLTIDP

SEQ ID NO: 8112 - protein, 872 aa, Secale cereale
MGVIGGGESVQWDKMNGAEVMNGGGSGAGSLDRIQVLVRVRPLSDKEIARGEPAEWECINDTTIMFRSTFPDRPTAPTAYTFDRVFHSECSTKEVYQEGVKEVALSVVSGINSSVFAYGQTSSGKTYTMTGVTECTVADIYDYISKHEERAFVLKFSAIEIYNEVVRDLLSAENTPLRLWDDAEKGTYVENLTEVILRDWNHLKGLISVCEAQRRTGETFLNEKSSRSHQILKLTVESSAREFLGKDKSTTLVASVNFVDLAGSERASQAMSAGTRLKEGCHINKSLLSLGTVIRKLSMGSNAHVPYRDSKLTRILQPSLGGNARTAIICTLSPATSHIEQSRNTLFFGSCAKDVVTNAQVNVVMSDKTLVKHLQKELARLESELRHPVSNSSLEAQVKEKDNQIRKMEKEIKELKSQRDLAQSRLQDLLQVVGDRDPKHQVSGKRSIRSPPSVGMPPSASRDDSSQISHDDSDHYKEVRCIETNETGGNERLSLSAGESTSPQDSNRNSSMRGNDSTASVNSRRLGETPITLEQHLENIRRPFITKDLGSSTRNPSSCRIIGRSRSCRSLTGSTLLDEMEMEDCTPVNRSLVIFPGRPEEYQRRGSALNYDAGSETLSRAGSEISTSKGASKTGDAEFTGIGEFVAELKEMAQVHYQKQLGDQSGRNGKSIGLDPIMDGLQSPSRWPLEFEKKQQEIIELWHACSISLVHRTYFFLLFKGESADSIYMEVELRRLSFLRDTFSRGSTPSNVVVGSLSSSPVASAKKLQREREMLARQMQKRFSVEERNHMYTKWSVPLDSKKRKLQVARRLWTESRDLEHVRESASLVAKLIGLQEPGQVLREMFGLSFAPQQPPTRRSSNGWRYGIPSFG

SEQ ID NO: 8113 - protein, 857 aa, Triticum aestivum
MNGAEVVNGGGSGAGSLDRIQVLVRVRPLSDKEIARGEPAEWECINDTTIMFRSTFPDRPTAPTAYTFDRVFHSECSTKEVYQEGVKEVALSVVGGINSSVFAYGQTSSGKTFTMTGVTECTVADIYDYINKHEERAFVLKFSAIEIYNEVVRDLLSAENTPLRLWDDAEKGTYVENLTEVILRDWNHLKGLISVCEAQRKTGETFLNEKSSRSHQILKLTVESSAREFLGKDKSTTLVASVNFVDLAGSERASQAMSAGTRLKEGCHINKSLLSLGTVIRKLSMGSNAHVPYRDSKLTRILQPSLGGNARTAIICTLSPATSHIEQSRNTLFFGSCAKDVVTNAQVNVVMSDKTLVKHLQKEVARLESELRQPVSNSSLEAQVKEKDNQIRKMEKEIKELKSQRDLAQSRLQDLLQVVGDRDPKHQVSGKRSIRSPPSVGMPPSASRDDSSQISHDDSDHYKEVRCIEPNETRGNERLSMSAGESTSPRASNRNSSMRGNDSTASVNSRRLGETPITLEQHLENIRRPFITKDLGSSTRNPSSCRVIGRSRSCRSLTGSTLLDEMEMEDCTPVNRSLVIFPGRPEEYQRRGSALNYDAGSETLSRAGSEISTSKGASKTGDAEFTGIGEFVAELKEMAQVHYQKQLGDQSGNGKSIGLDPIMDGLQSPSRWPLEFEKKQQEIIELWHACSISLVHRTYFFLLFKGESADSIYMEVELRRLSFLRDTYSRGSTPSNVTVGSLSSSPVASAKKLQREREMLARQMQKRLSVEERNHMYTKWSVSLDSKKRKLQVARRLWTESRDLEHVRESASLVAKLIGLQEPGQVLREMFGLSFAPQQPPARRSSNGWRYGIPSFG

SEQ ID NO: 8114 - protein, 866 aa, Brachypodium distachyon
MGAIGGEELVQWDKVNGPEGVNGGGSGAGKLDRIQVLVRLRPLNDKEIARGEPAEWECINDTTIMFRSTFPDRPTAPTAYTFDRVFHSECSTKEVYEQGVKEVALSVVSGINSSIFAYGQTSSGKTYTMTGVTENTVADIYDYINKHEERAFVLKFSATEIYNEVVRDLLSAENTPLRLWDDAEKGTYVENLTEVILRDWNHLKGLISVCEAQRRTGETFLNEKSSRSHQILRLIVESSSREFLGKDKSTTLVASVNFVDLAGSERASQAMSAGTRLKEGCHINKSLLSLGTVIRKLSMGSNAHIPYRDSKLTRILQPSLGGNARTAIICTLSPATSHIEQSRNTLFFGNCAKDVATNAQVNVVMSDKTLVKHLQKEVARLESELRHPVSNSSLETIVKEKDNQIRKMEKEIKELKSQRDSAESRLQDLLQVVGDRDPKHQVPGKRSVRSPPSVGMLPSTSRDDSSQISHDDSDHYKEVRCIETNETGLNELLCAGESVSLHDSNRNSSTHVNDSNASVNSRRLGETPITLEQHLENIRRPFITKDLGSSTRNSSGCRLIGRSRSCRSLTGSTLLDEMEMDDCTPVNRSLVNFPGRPEEYHRRGSALNYDAGSETLSRAGSEISTSKVACDAEFTGIGEFVAELKEMAQVHYQKQLGDQSANGKSIGLDPIMDVLQSPSRWPLEFEKKQQEIIELWHACSISLVHRTYFFLLFKGESADSIYMEVELRRLLFLRDTYSRGSTPSNVVVGSLSSSPVASAKKLLREREMLARQMQKRFSLEERNRIYTKWGVSLDSKKRKLQVARRLWTETKDLEHVRESASLVAKLIGLQEPGQVLREMFGLSFAPQQPPSRRSSNGWRYGIPSFG

SEQ ID NO: 8115 - protein, 63 aa, Triticum aestivum
APPLHFAGYSSGVRTEGVTREGLRTSLSVVGGINSSVFAYGPTSSGDDIHYAWGDGMPSSRYI

SEQ ID NO: 8116 - protein, 884 aa, Oryza sativa
MGAIGGDELVQWDKMGAAEAVNGGCGGAGKMDRIQVLVRLRPLSEKEVARREPAEWECINDSTVMFRSTFPDRPTAPTAYTFDRVFHSDCSTKEVYEEGVKEVALSVVSGINSSIFAYGQTSSGKTYTMTGVTEYTVADIYDYINKHEERAFVLKFSAIEIYNEVIRDLLSAENTPLRLWDDAEKGTYVENLTEVVLRDWNHLKGLISVCEAQRRTGETFLNEKSSRSHQILRLTVESSAREFLGKDKSTTLVASANFVDLAGSERASQALSAGTRLKEGCHINRSLLALGTVIRKLSMGSNAHIPYRDSKLTRILQPSLGGNARTAIICTLSPATSHIEQSRNTLLFGSCAKEVVTNAQVNVVMSDKALVKHLQKELARLESELRHPVQSSSLETLLKEKDNQIRKMEKEIKELKSQRDLAQSRLQDLLQSVGDHDLNRQVQGKHSVRSPPSVGMPPSVSRDDSSQVSHDDSDLYKEVRCIESNRTGGNDQLDLSAGESSSPQDSNMNSGLHGNDSNASVNSRHSRPSGEAPITLEEHLENIRRPFVSLAKDLGSSTRNSSNLRVIGRSRSCRSLTGSTMFDDMEMDDCTPLNRSLVEFPGRPVESHRRGSALHYDAETDTLSRAGSMSSEISTFKDAKTNGSVACDTEFTGIGEFVAELKEMAQVHYQKQLGDQNANGKSIGLDPIEGVSQSPSRWPLEFEKKQQEIIELWQACSISLVHRTYFFLLFKGEAADSIYMEVELRRLSFLRDTYSRGSTPSNAIVGSLSTSPVASAKKLQREREMLARQMQKRLSTEEREHTYTKWGVSLDSKRRKLQVARRLWTETKDLEHVRESASLVAKLIGLQEPGQVLKEMFGLSFAPQQQPTRRRSSNGWRYGIPSFA

SEQ ID NO: 8117 - protein, 882 aa, Panicum virgatum
MGAIGGDELVQWDKMAGPEAVNGGGGGAGRMDRIQVLVRLRPLSEKEVARGEPAEWECINDTTVMFRSTFPDRPTAPTAYTFDRVFHSDCSTKEVYDEGVREVALLVVSGINSSIFAYGQTSSGKTYTMTGVTEYTVADIYDYISKHEERAFVLKFSAIEIYNEVVRDLLSAENTPLRLWDDAEKGTYVENLTEVVLRDWNHLKGLISVCEAQRRTGETFLNEKSSRSHQMLRLTVESSAREFLGKDKSTTLVASANFVDLAGSERASQALSAGTRLKEGCHINRSLLALGTVIRKLSMGSNAHIPYRDSKLTRILQPSLGGNARTAIICTLSPATSHIEQSRNTLLFGSCAKEVVTNAKVNVVMSDKALVKHLQKEVARLESELRQPASNSSLEALVKEKDNQIRKMEKEIKELKSQRDLAQSRLQNLLQTVGDHSKHPGSGKRSARSPPSIGMPPSISRDDSSQISHDDSDLYKEVRCIETSGTGGNEQLDMSAGESSSPQGSNMNSSLRGNGSNTSVNSRRSRLLGESPVTLEQHLENIRRPFATVGRDLGSSTRNSSGSRILGRSRSCRSLTATTMFDGIEVDDDTPLHRSLVGFPGRPEGGHRRGSALNYDVESETLSRAGSIVSTKTNGACDAEFTGIGEFVAELKEMAQVHYQKQYGGQNANGDFGEGTIKSIGLDPIADASQSPSRWPLEFEKKQQEIIELWHSCSISLVHRTYFFLLFKGDQADSIYMEVELRRLSFLRDTYSRGSTPSNVVVGSLNSSPAASAKKLQREREMLARQMQKRLTAVEREHVYTKWGVSLDSKKRKLQVARRLWTQTKDLEHVRESASLVARLIGLQEPGQVLREMFGLSFAPQQQPPPRRRSSNGWKYGLPSFG

SEQ ID NO: 8118 - protein, 882 aa, Panicum virgatum
MGAIGGDELVQWDKMAGPEAVNGGGGGVGRMDRIQVLVRLRPLSEKEVARGEPVEWECINDTTVMFRSTFPDRPTAPTAYTFDRVFHSDCSTKEVYEEGVREVVLSVVSGINSSIFAYGQTSSGKTYTMTGVTEYTVADIYDYINKHEERAFVLKFSAIEIYNEVVRDLLSAENTPLRLWDDAEKGTYVENLTEVVLRDWNHLKGLISVCEAQRRTGETFLNEKSSRSHQILRLTVESSAREFLGKDKSTTLVASANFVDLAGSERASQALSAGTRLKEGCHINRSLLALGTVIRKLSMGSNAHIPYRDSKLTRILQPSLGGNARTAIICTLSPATSHIEQSRNTLLFGSCAKEVVTNAQVNVVMSDKALVKHLQKEVARLESELRQPASNSSLEALVKEKDNQIRKMEKEIKELKSQRDLAQSRLQNLLQTVGDHPKHSGSGKRSARSPPSIGMPPSISRDDSSQISHDDSDLYKEVRCIETSGTGGNEQLDMSAGESSSPQGSNMNSSLCGNGSNTSVNSRHSRLLGESPITLEQHLENIRRPFATVGRDLGSSTRNSSGSRILGRSRSCRSLTGTTMFDGMEVDDDTPLHRSLVGFPGGPEGNHRRGSALNNDVESETLSRAGSIVSTKTNGACDAEFTGIGEFVAELKEMAQVHYQKQYGGQNANGEFGEGTIKSIGLDPIADASQSPSRWPLEFEKKQQEIIELWHSCSISLVHRTYFFLLFKGDQADSIYMEVELRRLSFLSDTYSRGSTPSNVVVGSLNSSPAASAKKLQREREMLARQMQKRLTAVEREHVYTKWGISLDSKKRKLQVARRLWTRTKDLEHVRESASLVARLIGLQEPGQVLREMFGLSFAPQQQLPPRRRSSNGWKYGLPSFG

SEQ ID NO: 8119 - protein, 880 aa, Setaria italica
MGAIGGDELVQWDKMAGPEAVNGGGGGAGRMDRIQVLVRLRPLSEKEIARGEPAEWECINDTTVMFRSTFPDRPTAPTAYAFDRVFHSDCSTKEVYEEGVREVALSVVSGINSSIFAYGQTSSGKTYTMTGVTEYTVADIYDYINKHEERAFVLKFSAIEIYNEVVRDLLSAENTPLRLWDDAEKGTYVENLTEVVLRDWNHLKGLISVCEAQRRTGETFLNEKSSRSHQILRLTVESTAREFLGKDKSTTLVASANFVDLAGSERASQALSAGTRLKEGCHINRSLLALGTVIRKLSMGSNAHIPYRDSKLTRILQPSLGGNARTAIICTLSPATSHIEQSRNTLLFGSCAKEVVTNAQVNVVMSDKALVKHLQKEVARLESELRQPASNSSLEALVKEKDNQIRKMEKEIKELKSQRDLAQSRLQNLLQTVGDHPKHSGSGKRSARSPPSIGMPPGIIRDDSSQVSQDDSDLYKEVRCIETSGTGGNEQLDMSAGESSSPQGSNVNSSLRGNGSNTSVNSRRSRLLGESPITLEQHLENIRRPFASVGRDLGSSTRNSSGSRLLGRSRSCRSLTASTMFDGMEADDGTPVHRSLVGFPGRPERDHTSGSVLNYDAESETLSRAGSIVSAKTNGACDAEFTGIGEFVAELKEMAQVHYQKQYGDQNANGEFGEGTIKSIGLDPIADASQSPSRWPLEFEKKQQEIIELWHACSISLVHRTYFFLLFKGDQADSIYMEVELRRLSFLRDTYSRGGTPSNVVVGSLNSSPAASAKKLQREREMLARQMQKRLTAVERDHLYSKWGISLDSKKRKLQVARRLWTETKDLEHVRESASLVAKLLGLQEPGLREMFGLSFAPQQQPPPRRRSSNGWKYGLPSFG

SEQ ID NO: 8120 - protein, 880 aa, Zea mays
MGAIGGNESVQWDKVAGADAVNGGGTSVGRMDRIQVLVRLRPLSEKEVARGEPAEWECINDTTVMFRSTFPDRPTAPTAYTFDRVFHSDCSTKEVYEEGVREVALSVVSGINSSVFAYGQTSSGKTYTMNGVTEYTVADIYDYINKHEERAFVLKFSAIEIYNEAVRDLLSAENTPLRLWDDAEKGTYVENLTEVVLRDWNHLKGLISVCEAQRRTGETFLNEKSSRSHQILRLTIESSAREFLGKDKSTTLVASANFVDLAGSERASQALSAGTRLKEGCHINRSLLALGTVIRKLSMGSNAHIPYRDSKLTRILQPSLGGNARTAIICTLSPATSHIEHSRNTLLFGSCAKEVVTNAQVNVVMSDKALVKHLQKEVARLESELRQPASNSSLEALVKEKDNQIRKMEKEIKELKSQRDLAQSRLQNLLETVGDQVKHSGSGKRSARSPPSIGISPGISRDDSSQISHDDSDLFKDVRCIGTSGTGGNEQLDLSAGESSSLQGLNMNSSLHGSGSNASVNSRRSRLLSESPITLEQHLENIKRPFVSLGRDLGSSTHNSSGSRILGRSRSCRSLMGSTMFDGMEMDDGTPLHRSLVGFPGRPEGNHRRGSTPNHDAESETLSRAGSVVSTKTNAACDAEFTGIGEFVAELKEMAQVHYQKQLGNQITNGEFVDIKNIGLDPIADASQSPSRWPLEFEKKQQEIIGLWHACCISLVHRTYFFLLFKGEQADSIYMEVELRRLSFLRDTYSRGNTPSNAVVGSLNSSPAASAKKLQREREMLARQMQKRLTAEERERLYTKWGISLDSKKRKLQVARRLWTEAEDLEHVRESASLVAKLIGLQEPGQVLREMFGLSFAPQQQPPPRRRSSNGWRYGIPSFG

SEQ ID NO: 8121 - protein, 311 aa, Secale cereale
MARPRAWAPLPGPALSLLSVILLLVGRRGAAVAGGGRGRGSSVYPAPVVYPHHSRQISWHPRVFLYPHFLTDDEANHLVSLARAELKRSAVADETSGKSQLSEVRTSSGTFISKGQDPIVAGIEDKIAAWTFLPKENGEDMQVLRYKRGEKYEPHYDFFTDSVNTIRGGHRVATVLLYLTDVAEGGETVFPLAKARKGSHHKDLSECAQKGIAVKPRKGDALLFFNLRPDAETDPLSLHGGCEVIKGEKWSATKWIRVASFDKVYHMPGNCTDSSNSCSQWAALGECTKNPAYMVGTAALPGHCRRSCNVC

SEQ ID NO: 8122 - protein, 256 aa, Panicum virgatum
MAASAMPLLLVLLLASPAATRLASAACASEKFPAGRTYATCEDLPKLGASLHWTYDASKSSLSVAFVAAPAAPGGWVAWGLNPAGEGMAGAQALVALKGSGSAAPTVKTYNISGYALGAPSPLEFPATELAADAGGSGGKIRVYGKLQLRKGMKAVNQVWQVGSSATGGAPDKHAFGAENLAAKGKLVLAGSKAAAGAPAAAPEAGGPAASGGSDSGAASSMAPSGGKSPNAAVSTARVSAPALLALTLVGLLATV

SEQ ID NO: 8123 - protein, 264 aa, Panicum virgatum
MAAAAAAMPLLLLALLLASPAATRLASAACASEKFPAGRTYATCEDLPKLGASLHWTYDASKSSLSVAFVAAPAAPGGWVAWGLNPSGEGMAGAQALVALKGSGSAASTVKTYNISGYALGAPSPLEFPATELAADAGGSGGKIRVYGKLQLRKGMKAVNQVWQVGSSATGGAPDKHAFGADNLSAKSKLVLAGSKAAAGAPAASPAAAPEAGGPAASGSDSGAASSMAPSAGNGKTPNAAVSTAAVSAPALLALALVGLLAAV

SEQ ID NO: 8124 - protein, 258 aa, Sorghum bicolor
MAHHLALLLLLLASPAATRLASAACGSEKFPAGRAYASCEDLPKLGASIHWTYDASKTSLSVAFVAAPAAAGGWVAWGLNPTGEGMAGTQALVALAGSGSAAPTVRTYNITGYVPLGKASTPLDFPATDLAADAAGSGGKIRVYGKLQLRKGMKAVNQVWQVGASSTGGAPDKHAFQADNLSAKSKLVLAGKAAAAEAPSPASPAPEAGGPSASGAGSDSGAASSMSPSKSPNAAVPAAGVSAPALLVLALVGFLVTV

SEQ ID NO: 8125 - protein, 289 aa, Pennisetum glaucum
MSSSSSSSSSAVPFEKPRAVVKKLLAESQPEGQGATVRRSIGRHELRNLDPFLMLDEFSVSKPAGFPDHPHRGFETVTYMLEGAFTHQDFAGHKGTIRAGDVQWMTAGRGIVHSEMPAGDGVHKGLQLWINLSSKDKMIEPRYQELCSEDISRAEKDGVEVRIIAGEAFGVRSPVYTRTPTMYMDFTMRPGSRLHQPVPEGWNAFAYIIDGEGVFGREESAPPVPAHHCVVLGPGDGVSVWNRSAAPLRFALVAGQPLGEPVVQHGPFVMNSRAEIQQAMEDYYYGKNG

SEQ ID NO: 8126 - protein, 251 aa, Panicum virgatum
MENVLFDRSSGSLEFPKTRSLGRSRRGLGARPAAPGGAYSSFPMLQPYNHLHNGGAWTSAPALPYARPPIYSSPSLPLLPSNQPPLLPLPPAATKYATFPCLPAAPPPPPPAPRAGRSAAVTTTVPAAAAAPAPARRERDRRRRPARPPPPSTAEAPRAQKKKPLERATPLPPAPVVNEALDDLEQEVARNFVQELLHALAPPPSSLPMPRFSLVMKASPATASRAVAVPAAPSCNVEAATADGIHGLLRL

SEQ ID NO: 8127 - protein, 246 aa, Panicum virgatum
MENVLLDRSSGRLEFPKTRSLSRSRRGPGAKPAAPGGAYGSFPMLQPYNHLHNGGAWTSAPALPYARPPIYSSPSLPLLPSNQPPLLPLPPTAAKYATFPCLPAAPPPPPPAPRAGRGAAVTTTVPAAEAAPAPARRERDRRRRPAKPSTAEAPRAQKKKPLERATPLPPAPVVTEALDDLEQEVARNFVQELLHALAPPPSSLPMPRFSLVMKAPATASRTVAPAAPSCNVEAATADGIHGLLRL

SEQ ID NO: 8128 - protein, 256 aa, Saccharum officinarum
MENVLLDRSSSRSLEFPKRSLGRSRRGPAGARPAVPGGGSYSSFPTWQPYNHLHKGGAWTSAPALPYARSPTPMIYSSPSLPLLPSNQPPLLPLPPIATKYATFPGLPAAPPPPPPAPRAAGRAAAATTTVSAAAAPAPAPPRQRDRRRRPARPPPTTTERSSTPQKKKPLERATPLPPAPVVTEALDDLEQEVARNFVQDLLHVLAPPPSSLPLPSFSLVVKASPARDTRVVAPAAPTCNVEAATADGIRGLLRL

SEQ ID NO: 8129 - protein, 140 aa, Zea mays
MAHSLAASFSPAAARRQVTNVIPSWTSVSFQSHRMTSVSIRSRQRSLGFKICCSAKKETVDKVCSIVKEQLALPDGTAITAESKFAELGADSLDTVEIVMGLEEAFNITVDETSAQDIATVQDAADLIEKLMLEAPPKVV

SEQ ID NO: 8130 - protein, 132 aa, Panicum virgatum
MAHSLAAAASFSPAAARRQVTNVSFQSHRMTSVSIRSRPNSLRLKICCSAKKETVDKVCSIVKEQLALPDGTALSGESKFAELGADSLDTVEIVMGLEEAFNITVDETSAQDIATVQDAADLIEKLVLEKAA

SEQ ID NO: 8131 - protein, 178 aa, Cenchrus ciliaris
MLATACGAPPCPCARSRLLPSASLGIGFGGACVRNTRRRTPRRAAVVRCGLLPVDPWAPTMDSQSVASQLFAVSLFPYLGFLYFMTRSKTAPGLTLFGFYFLLVFVGATIPAGIYAKVHYGTSLSNVDWLHGSAESLLTLTNLFIVLGLRGALRKLEEEDTKESISEASQDSKEKSSV

SEQ ID NO: 8132 - protein, 349 aa, Sorghum bicolor
MLLTKPHLSNSFLPVPSPPPSSPTLSFSSNHARPLAAPICRRSRLRISATSTAAPAPSAAAAAAATAALSRVDVLSEALPFIQRFKGKTVVVKYGGAAMKSPELQASVIRDLVLLSCVGLRPVLVHGGGPEINSWLLRVGVEPQFRDGLRVTDALTMEVVEMVLVGTVNKNLVSLINIAGGTAVGLCGKDARLITARPSPNAAALGFVGEVSRVDAAVLHPIIAAGHIPVIATVAADETGQAYNINADTAAGEIAAAVGAEKLLLLTDVSGILADRNDPGSLVKEIDIAGVRQMVADGKVAGGMIPKVECCVRALAQGVHTASIIDGRVPHSLLLEILTDEGTGTMITG

SEQ ID NO: 8133 - protein, 343 aa, Oryza sativa
MLLAKPHLSSSSFLPSTRVSSPAPGPNHAKPIAASPAPRRCLRLAVTSAAAPAASSAEAAAALSRVDVLSEALPFIQRFKGKTVVVKYGGAAMKSPELQASVIRDLVLLSCVGLHPVLVHGGGPEINSWLLRVGVEPQFRNGLRVTDALTMEVVEMVLVGKVNKHLVSLINLAGGTAVGLCGKDARLLTARPSPNAAALGFVGEVSRVDATVLHPIIASGHIPVIATVAADETGQAYNINADTAAGEIAAAVGAEKLLLLTDVSGILADRNDPGSLVKEIDIAGVRQMVADGQVAGGMIPKVECCVRALAQGVHTASIIDGRVPHSLLLEILTDEGTGTMITG

SEQ ID NO: 8134 - protein, 346 aa, Oryza sativa
MMLTKPHPSSNLLLPTTTALPNPSPNPSRVTPLASGRGRRGHHRVCASSVAPAQPASVAQPTAPALSRVDVLSEALPFIQRFRGKTVVVKYGGAAMKSPELQSSVIRDLVLLSCVGLRPVLVHGGGPEINSWLGRVGVEPQFRNGLRVTDALTMEVVEMVLVGKVNKQLVSLISVAGATAVGLCGKDARLLTARPSPDAAALGFVGEVTRVNPSVLHPIIESGHIPVIATVAADETGQAYNINADTAAGEIAAALGAEKLLLLTDVSGILADRNDPGSLVKEIDIAGVRQMVADGKVGGGMIPKVECCVRALAQGVHTASIIDGRVPHSLLLEILTDEGTGTMITG

SEQ ID NO: 8135 - protein, 327 aa, Oryza sativa
MRNPPGRHLLRVATRAVRSSSALGSGGGGGGASTSATSPVAASSSSGGRPRTRSGGRLLRATSPPPPSAIAAAACWESRTMRREGEEEWEEVVAGAEEAVHGAPVPVAEEEEEYRVVFWSPPTGDEVRAAFTSIEEVFGDPFRAHSYETEEQSALSTSVHSSSGNSSGSDDWIEPAAYALNSTALLTREHRNVLDAFRLLQKDPNVQKMVMSLSCDRAVWDAVMNNEAVQEFRRSFQDDKEAAGRKGNPGGPAGVLKWILGNTQAKIMEFMNNIMKIVNMLFHSDDDEAKPDLYTDAVKVSFMLSVFIFIVVAIARINFEPWDFKVW

SEQ ID NO: 8136 - protein, 334 aa, Hordeum vulgare
EHQPSPRPNDRRRSHAPHEAPALFLPTRIHAALYPRIHPQPRQANRRLSRPPALSRVDVLSEALPFIQRFKGKTVVVKYGGAAMKSPELQSSVIRDLVLLSCVGLRPVLVHGGGPEINSWLLRVGVEPQFRNGLRVTDALTMEVVEMVLVGKVNKNLVSLINLAGGTAVGLCGKDARLITARPSPNAAALGFVGEVARVDASVLHPIIASGHIPVIATVAADETGQAYNINADTAAGEIAAAVGAEKLLLLTDVSGILADRNDPGSLVKEIDIAGVRQMVSGGQVAGGMIPKVECCVRALAQGVHTASIIDGRVPHSLLLEILTDEGTGTMITG

SEQ ID NO: 8137 - protein, 69 aa, Sorghum bicolor
MAAAGEASSKLLRFMYFVGAGVICTKAINTYRDYEHKKEASAAVAAAESALAAAAAAEPAPATAAAAKP

SEQ ID NO: 8138 - protein, 70 aa, Panicum virgatum
MAAAGEASSKLLRFLYFVGAGVICTKAINTYRDYEHKKDASAAVAAAEAALASAAAPEPAPATAAAAAKP

SEQ ID NO: 8139 - protein, 89 aa, Panicum virgatum
LGPGASSDRFRRPPHQATTMAAAGEASSKLLRFLYFVGAGVICTKAINTYRDYEHKKDASAAVAAAEAALASAAAPEPAPATAAAAAKP

SEQ ID NO: 8140 - protein, 71 aa, Panicum virgatum
MAAAGEASSKLLRFLYFVGAGVICTKAINTFRDYEHKKEASAAVAAAEAALASASAPEPAPATVAAAAGKP

SEQ ID NO: 8141 - protein, 379 aa, Zea mays
MVAEQATTTVAVGEPPTATPQPAAAAAAGQRSVPTPFLTKTYQLVDDPAVDDVISWNDDGSAFIVWRPAEFARDLLPKYFKHNNFSSFVRQLNTYGFRKIVPDRWEFANDCFRRGEKRLLCDIHRRKVTLPVAAATRAVTVVATIPMALPVDSPVYSGEEQVLSSSSSPEPPSLLQQQPTPSASGSGDMGEENERLRRENAWLARELGQMKKLCNNILLLMSKYAATKQPDAAKAAAAGNCSGGESSGAAAAPPLPSILELLPSCRRDPASAAVDAAAAAAGTEHEVDEKAGARLFGVSIGRKRMRDESSGHGGGGEDPVGRSAEVKAEPVDARLDHQHSATEPQSWPIYRPRPVYHPLRACSGLVSAGSDHDWSNNSR

SEQ ID NO: 8142 - protein, 440 aa, Panicum virgatum
MASSSMDTEAAGQELKGGGYTVAATAHAVDSDSWQQVGLLLVIGFNCAYVLSFSNLMMAPLGWGWGVACLLLVGAAAWYANWLLAGLHFIDGQRFIRYRDLMGFVFGRKMYYITYFLQFTTLLLCNMGFILLGARALKAINVEFTHSPARLQWFITATGIVYFAFAYFVPTISAMRNWLATSAALTLAYDVALLAILIRDGKSNKQKDYNVHGSPAEKVFNALGAVAAILVCNTSGLLPEIQSTVREPAVRGMRRALLLQYTAGAAAYYGVSVAGYWAYGSSVSEYLPNELGGPRWAAVLINATAFLQSVVSQHLFAVPIHEAMDTRLQRLEEGMFSRYNLTRRFFARGLIFGFNIFVTALFPFMGDFVNLFGSFALVPLTFMFPSMVVLKIEGKSSGRWSRLWHWGVIVFSSVLCVATTAAAVRLIFNNARIYHFFADM

SEQ ID NO: 8143 - protein, 445 aa, Hordeum vulgare
MASSSLDTEAGGAQHKAAGGDSGGYTTAATAHAVDTDSWQQVGLLLVTGFNCAYVLSFSNLMMVPLGWGWGAACLLLLAAAAWYANWLLAGLHVVDGQRFIRYRDLMGFVFGRKMYYLTWFLQFTTLLLGSMGFILLGGRALKAISAEFTETPPRLQWFIAATGLVYFAFAYFVPTISAMRNWLATSAALTVTFDVALLAVLVRDGRSNERRDYGIHGTGAEKVFNALGAVAAILVCNTSGLLPEIQSTLRKPSVANMRRALALQYTVGAAGYYGISVAGYWAYGAAASEYLPNQLSGPRWASVLINATAFLQSIVSQHLFTVPIHEAMDTGLQRLEEGMFSRYNMTRRLLARGVLFGVNIFVTALFPFMGDFVNLFGSFALFPLTFMFPSMIILKIKGECDGRPGRLWHWGIIVVSSAVGLATSAAAVRLILHNASVYRFFADT

SEQ ID NO: 8144 - protein, 447 aa, Oryza sativa
MAASSLDAEAAAAGQQDKAGSGSYTTAATAHQIDTDSWQQVGVLLVVGFNCAYVLSFSNLMMAPLGWGWGIACLLFIGAASWYANWLLAGLHVIDGQRFIRYRDLMGFVFGRKMYYITWFLQFITLILGNMGFILLGGRALKAIHAEFSSSHSPARLQWFIAATGFVYFAFAYFVPTISAMRNWLATSAALTVAYDVALIVILIKDGKSNKQKDYNVHGTQAEKVFGAFGAIAAILVCNTSGLLPEIQSTLRKPVVSNMRRALLLQYTAGAAVYYGISVAGYWAYGAAVSEYLPDQLSGPSWATVLINATAFLQSIVSQHLFTVPIHEALDTQMQRLDEGMFSRYNLGRRLLARGLVFGANAFVTALFPFMGDFVNLFGSFVLFPLTFMFPSMVVLKIKGKDEAGRWNRIWHWGIIVASSVLSVVTTAAAVRLIVHNASVYHFFADM

SEQ ID NO: 8145 - protein, 1135 aa, Zea mays
MSSPSNNRGTCSRSSSARSKHSARVVAQTPVDAQLHADFEGSQRHFDYSSSVGAANRPSASTSTVSTYLQNMQRGRYIQPFGCLLAVHPDTFALLAYSENAPEMLDLTPHAVPTIDQRDALTIGADVRTLFRSQSSVALHKAATFGEVNLLNPILVHARTSGKPFYAILHRIDVGLVIDLEPFNPADVPVTAAGALKSYKLAAKAISRLQSLPSGNLSLLCDVLVREVSELTGYDRVMAYKFHEDEHGEVISECRRSDLEPYLGLHYPATDIPQASRFLFMKNKMRMICDFSATPVLIIQDGSLAQPVSLCGSTLRASHGCHAQYMANMGSVASLVMSVTINDDEEEDGDTDSDQQPKGRKLWGLVVCHHTSPRFVPFPLRYACEFLLQVFGIQLSKEVELAAQAKERHILRTQTLLCDMLLRDALVGIFTQSPNVMDLVKCDGAALYYQNQVLVLGSTPSESEIKSIATWLQENHDGSTGLSTDSLVEAGYPGAAALREVVCGMVAIKISSKNFIFWFRSHTTKEIKWSGAKHEPFDADDNGRKMHPRSSFKAFLEVVKWRSVPWEDVEMDAIHSLQLILRDSLQGEDANRNNIRSIVKAPSDDMKKLQGLLELRTVTNEMVRLIETATAPVLAVDIAGNINGWNKKAAELTGLPVMEAIGRPLIDLVVADSVEVVKQILDSALQGIEEQNLEIKLKTFHEQECCGPVILMINSCCSRDLSEKVIGVCFVAQDLTRQKMIMDKYTRIQGDYVAIIKNPSELIPPIFMINDLGSCLEWNKAMQKITGMKREDAINKLLIGEVFTLHDYGCRVKDHATLTKLSILMNAVISGQDPEKLLFGFFGTGGKYIESLLTVNKRTNAEGKITGALCFLHVASPELQHALEVQKMSEQAATNSFKELTYIRQELRNPLNGMQFTYNLLKPSELTEDQRQLVSSNVLCQDQLKKILHDTDLESIEQCYMETNTVEFNLEEALNTVLMQGIPLGKEKRISIERDWPVEVSHMYIYGDNIRLQQVLADYLACALQFTQPAEGHIVLQVIPKKENIGSGMQIAHLEFRIVHPAPGVPEALIQEMFQHNPGVSREGLGLYISQKLVKTMSGTLQYLREADTSSFIILIEFPVAQLSSKRSKPSPSKF

SEQ ID NO: 8146 - protein, 1135 aa, Sorghum bicolor
MSSPLNNRGTCSRSSSARSRHSARVVAQTPVDAQLHAEFESSQRNFDYSSSVSAAIRPSVSTSTVSTYHQTMQRGLYIQPFGCLLAVHPDTFTLLAYSENAPEMLDLTPHAVPTIDQRDALAVGADVRTLFRSQSSVALHKAATFGEVNLLNPILVHARTSGKPFYAILHRIDVGLVIDLEPVNPVDVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSATLVKIIQDDSLAQPLSLCGSTLRASHGCHAQYMANMGSVASLVMSVTISNDEEEDVDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQLLLLGSTPSESEIKSIATWLQENHDGSTGLSTDSLVEAGYPGAAALREVVCGMAAIKISSKDFIFWFRSHTTKEIKWGGAKHEPVDADDNGRKMHPRSSFKAFLEVVKWRSVPWEDVEMDAIHSLQLILRGSLQDEDANRNNVRSIVKAPPDDTKKIQGLLELRTVTNEMVRLIETATAPVLAVDIAGNINGWNNKAAELTGLPVMEAIGRPLIDLVVVDSIEVVKRILDSALQGIEEQNLEIKLKAFHEQECNGPIILMVNSCCSRDLSEKVIGVCFVGQDLTTQKMIMDKYTRIQGDYVAIVKNPSELIPPIFMINDLGSCLEWNKAMQKITGIQREDVIDKLLIGEVFTLHDYGCRVKDHATLTKLSILMNAVISGQDPEKLLFGFFDTDGKYIESLLTVNKRINAEGKITGAICFLHVASPELQHALQVQKMSEQAATNSFKELTYIHQELRNPLNGMQFTCNLLEPSELTEEQRKLLSSNILCQDQLKKILHDTDLESIEQCYMEMNTVEFNLEEALNTVLMQGIPLGKEKRISIERDWPVEISRMYLYGDNLRLQQVLADYLACALQFTQPAEGPIVLQVIPKKENIGSGMQIAHLEFRIVHPAPGVPEALIQEMFRHNPEVSREGLGLYICQKLVKTMSGTVQYLREADTSSFIILIEFPVAQLSSKRSKPSTSKF

SEQ ID NO: 8147 - protein, 1135 aa, Pennisetum glaucum
MSSSRSNNRGTCSRSSSARSKHSARVVAQTPVDAQLHAEFEGSQLHFDYSTSVGAGNRPSASTSTVSAYLQNMQRGRYIQPFGCLLAVHPDTFALLAYSENAPEMLDLTPHAVPTIDQRDALAVGADVRTLFRSQSAVALHKAATFGEVNLLNPILVHARTSGKPFYAIMHRVDVGLVIDLEPVNRADVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCSAVPVKIIQDDSLAQPLSLCGSTLRASHGCHTQYMANMGSVASLVMSVTINEDEEDGDTGSDQQPKGRKLWGLVVCHHTSPRFVPFPLRYACEFLLQVFGIQLNKEVELAAQAKERHILRTQTLLCDMLLRDAPVGIFTQSPNVMDLVKCDGAALYYQNQVWALGSAPSEAEIRCIVAWLQENHDGSTGLSTDSLVEAGYPGAAALREVVCGMAAIKISSKDFIFWFRAHTAKEIKWGGAKHEAVDADENGRKMHPRSSFKAFLEVVKWRSVPWEDVEMDAIHSLQLILRGSLQDEDSNRNNVRTIVKAPSEDTKKIQGLLELRTVTDEMVRLIETATAPILAVDVAGNINGWNNKAAELTGLPVMEAIGRPLVDLVVSDSVEVVKQILDSALQGIEERNLEIRLKTFNQQECNGPVILMVNSCCSRDLSDNVVGVCFVAQDLTGQKMIMDKYTRIQGDYVAIVKNPSELIPPIFMINDLGSCLEWNEAMQKITGMKREDAIDKLLIGEVFTLHDYGCRVKDHATLTKLSILMNTVISGQDPGKLLFGFFDTDGKYVESLLTASKRTNVEGKITGALCFLHVASPELQHALQVQKMSEQAATNSFKELTYIRQELRNPLNGMQFTHSLLEPSELTEEQRRLVASNVLCQDQLKKILHDTDLESIEQCYMEMNTVEFKLEEALNTVLMQGMPLGKEKQISIERDWPVEVSCMHLYGDNLRLQQVLADYLACTLQFTQSAEGPIVLQVIPKKENIGSGMQIAHLEFRIVHPAPGVPDALIQEMFRHSPEVSREGLGLYISQKLVKTMSGTVQYLREADRSSFVVLVEFPVAQLSSKRSKPSTSKF

SEQ ID NO: 8148 - protein, 1135 aa, Panicum virgatum
MSSSRSNNRARSSSARSKHSARVVAQTPVDAQLHTEFEGSQRHFDYSSSVSAANRPSASTSTSTVSTYLQNMQRGRFIQPFGCLLAVHPDTFALLAYSGNAPEMLDLTPHAVPTIDQRDALAIGADVRMLFRSQSSVALHKAASFGEVNLLNPILVHARTSGKPFYAIMHRIDVGLVIDLEPVNPAEVPVTAAGSLKSYKLAAKAISRLQSLPSGNLSLLCDVLVREVSELTGYDRVMAYKFHEDEHGEVIAECRRSDLEPYLGLHYPATDIPQASRFMFMKNKVRMIYDCSATPVKIIQDDSLAQPLSLCGSTLRAPHGCHTQYMANMGSVASLVMSITINEDAEEDGDTGSDQQPKGRKLWGLVVCHHMTPRFVPFPLRYACEFLLQVFGIQLNKEVELAAQAKERHILRTQTLLCDMLVRDAPVGIFTQLPNVMDLVKCDGAALYYQNQLWVLGSTPSKAEIKSIVTWLQENHDGSTGLSTDSLVEAGYPGAAALREVVCGMAAIKISSKDFIFWFRAHTAKEIKWGGSKHETVDADENGRQMHPRSSFKAFLEVVKWRSVPWEDVEMDAIHSLQLILRGSLQDKDANKNNVMSIVEAPSEDTKNIQGLLELRTVTNEMVRLIETATAPIFAVDIDGNINGWNNKVAELTGLPVMEAIGRPLVDLVMSDSVEVVKLILDSALPGIEEQNLEIKLKTFNQQECNGPVILMVNSCCNRDLSDKVVGVCFVAQDLTGQKMIMDKYTRIQGDYVTIVKNPSELIPPIFMINDLGSCLEWNEAMQRITGMKREDAIDKLLIGEVFTLHDYGCRVKDHATLTKLSILMNTVISGQDPGKLLFGFFDTYGKYVESLLTANKRTNVEGKITGALCFLHVASPELQHALKVQKMSEQAAANSFKELTYIRQELRNPLNGMQFTHSLLEPSELTEEQRRLVASNVLCQDQLKKILHDTDLESIEQCYMEMNMEEFKLEEALNTVLMQGMSLGKEKWISIERDWPVEVSSMYLYGDNLRLQQVLADYLACTLQFTQPAKGPIVLQVIPKKENIGSGMQIAHLEFRIVHPAPGVPEALIQEMFRHSSEVSREGLGLYISQKLVKTMSGTVQYLREADSSSFIVLVEFPVAQLSSKRSKPSTSKF

SEQ ID NO: 8149 - protein, 1137 aa, Oryza sativa
MSSSRSNNRATCSRSSSARSKHSARVVAQTPMDAQLHAEFEGSQRHFDYSSSVGAANRSGATTSNVSAYLQNMQRGRFVQPFGCLLAVHPETFALLAYSENAAEMLDLTPHAVPTIDQREALAVGTDVRTLFRSHSFVALQKAATFGDVNLLNPILVHARTSGKPFYAIMHRIDVGLVIDLEPVNPVDLPVTATGAIKSYKLAARAIARLQSLPSGNLSLLCDVLVREVSELTGYDRVMAYKFHEDEHGEVIAECKRSDLEPYLGLHYPATDIPQASRFLFMKNKVRMICDCSATPVKIIQDDSLTQPISICGSTLRAPHGCHAQYMASMGSVASLVMSVTINEDEDDDGDTGSDQQPKGRKLWGLMVCHHTSPRFVPFPLRYACEFLLQVFGIQINKEVELAAQAKERHILRTQTLLCDMLLRDAPVGIFTQSPNVMDLVKCDGAALYYQNQLWVLGSTPSEAEIKNIVAWLQEYHDGSTGLSTDSLVEAGYPGAAALGDVVCGMAAIKISSKDFIFWFRSHTAKEIKWGGAKHEPIDADDNGRKMHPRSSFKAFLEVVKWRSVPWEDVEMDAIHSLQLILRGSLQDEDANKNNNAKSIVTAPSDDMKKIQGLLELRTVTNEMVRLIETATAPILAVDITGSINGWNNKAAELTGLPVMEAIGKPLVDLVIDDSVEVVKQILNSALQGIEEQNLQIKLKTFNHQENNGPVILMVNACCSRDLSEKVVGVCFVAQDMTGQNIIMDKYTRIQGDYVAIVKNPSELIPPIFMINDLGSCLEWNEAMQKITGIKREDAVDKLLIGEVFTHHEYGCRVKDHGTLTKLSILMNTVISGQDPEKLLFGFFNTDGKYIESLMTATKRTDAEGKITGALCFLHVASPELQHALQVQKMSEQAAMNSFKELTYIRQELRNPLNGMQFTRNLLEPSDLTEEQRKLLASNVLCQEQLKKILHDTDLESIEQCYTEMSTVDFNLEEALNTVLMQAMPQSKEKQISIDRDWPAEVSCMHLCGDNLRLQQVLADFLACMLQFTQPAEGPIVLQVIPRMENIGSGMQIAHLEFRLVHPAPGVPEALIQEMFRHSPGASREGLGLYISQKLVKTMSGTVQYLRESESSSFIVLVEFPVAQLSTKRCKASTSKF

SEQ ID NO: 8150 - protein, 538 aa, Sorghum bicolor
MGGGDGDADAGGEPAAAQATLHIRCTNGSKFAVRADLGTTVGAFKAIVAESCDVPAPQQRLIYKGRILKDDQTLASYGVETDHTIHMVRGAAPPPASTAPAANQEPTTAAPASSPAAGLGGLLQSLGATGAAANSGGSGLFGSGLPELDQMQQQLAENPNLMREIMNMPLMQNLMNSPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFAALLGNQGSNQARDSAANGTTTASDPTSGSPAPNTNPLPNPWGPNAGSTQGAARSPPASNTRSTTASGLGGLGSADLGSMLGASGGGSDATFLTQVLQNPTMMQMMQNIMSNPQSMNQLLNMNPNVRNMMESNTQMREMIQNPEFLRQLTSPETLQQLISFQQSLMSQLGQQQAGQERTQSGSGAGNVNLNTLMNMFSGLGAGGGLGVPNAPNVPPEELYATQLAQLQEMGFFDTQENIRALAATAGNVHAAVERLLGNMGQ

SEQ ID NO: 8151 - protein, 536 aa, Zea mays
MGGGDADAGGEPAAAQATLHIRCTNGSKFAVRADLGATVGTFKAIVADSCDVPAPQQRLIYKGRILKDEQTLASYGVETDHTIHMVRGAAPPPASTAPAANQEPTTAAPASSPAAGLGGLLQNLGATGAAANSGGLGLFGSGLPELDHMQQQLAENPNLMREIMNMPLMQNLMNSPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFAALLGNQGSNQARDSAANGTTTASDTTSGAPAPNTNPLPNPWGPNAGSAQGAARSPPATNTRSTTAGGPGGLGSADFGSTLGASGGGSDATFLTQVLQNPTMMQMMQNIMSNPQSMNQLLNMNPNVRNMMESNTQMREMIQNPEFIRQLTSPETLQQLISFQQSLMSQLGQQQTGQERTQSASGAGNVNLNTLMNMFSGLGAGGGLGVPNAPNVPPEELYATQLAQLQEMGFFDTQENIRALAATAGNVHAAVERLLGNMGQ

SEQ ID NO: 8152 - protein, 534 aa, Panicum virgatum
MGGGDADADAGGEHAAAQATLHIRCTNGSKFAVRADLGATVGAFKAIVAESCDVPAPQQRLIYKGRILKDEQTLASYGVETDHTIHMVRGAAPPLASTAPAANQETSTTAPASSPAAGLGGLLPGLGATGAANSGGLGLFASGLPELDQMQQQLADNPNLMREIMNMPLMQNLMNNPDLIRNIIMNNPQMRELIDRNPDLAHVLNDPSILRQTVEAARNPELMREMMRNTDRAMSNIESSPEGFNMLRRMYETVQEPFLNATTMGGEGDRNANPFAALLGNQGTNQTRDPAANAPTTASDPAAGSPAPNTNPLPNPWGSNAGSAQGAARPPPASNTNTRTATAGGLGGLGSADLGSVLGGGADASFLSQVLQNPTMMQMMQNIMSNPQSMNQLFNMNPNVRNMMESNTQLREMFQNPEFLRQLTSPETLQQLISFQQSLMSQLGQQAGQERTQSGTGAGNVNLNTLMNMFSGLGAGGGLGVPNAPNVPPEELYATQLTQLQEMGFFDTQENLRALIATAGNVHAAVERLLGNLG

SEQ ID NO: 8153 - protein, 536 aa, Setaria italica
MGGGDAGADPGAEPAAAQATLHIRCTNGSKFAVRADLGATVGAFKAIVAESCDVPAPQQRLIYKGRILKDEETLASYGVETDHTIHMVRGAAPPPASTARAANQETSSTAPASSPAAGLSGLLQGLGGTGAANSGGLGLFGSGLPELDQMQQQLAENPNLMREMMNMPLMQNLMNNPDLMRNIIMNNPQMRELIDRNPDLAHVLNDPSILRQTVEAARNPELMREMMRNTDRAMSNIESSPEGFNMLRRMYETVQEPFLNATTMGGEGDRNPNPFAALLGNQGSNQARDPAANAPTTASDPAAGSPAPNINPLPNPWGTNAGSAQGAARPPPASNTNTRSATAGGLGGLGSADLGSVLGGGSDASFLSQVLQNPTMMQMMQNIMSNPQSMNQLLNINPNVRNMMESNTQLREMFQNPEFLRQLTSPETLQQLISFQQSLVSQLGQQQAGQERTQSGTGAGNVNLNTLMNMFSGLGAGGGLGVPNAPNVAPEELYATQLAQLQEMGFFDTQENLRALIATAGNVHAAVERLLGNLGQ

SEQ ID NO: 8154 - protein, 536 aa, Panicum virgatum
MGGGDADAAGEPAAAQATLHIRCTNGSKFAVRADLGATVGAFKAIVAESCDVPAPQQRLIYKGRILKDEQTLASYGVETDHTIHMVRGAAPPLASTAPAANQETSTTAPASSPAAGLGGLLPGLGATGAANSRGLDLFGSGLPELDQMQQQLADNPNLMREIMNMPLMQNLLNSPDLIRNIIMNNPQMRELIDRNPDLAHVLNDPSILRQTVEAARNPELMREMMRNTDRAMSNIESSPEGFNMLRRMYETVQEPFLNATTMGGEGDRNANPFAALLGNQGTNQPRDPAANAPTTASDPAAGSPAPAPNTNPLPNPWGSNAGSAQGAARPPPASNTNTRTATAGGLGGLGSADLGGVLGGGADASFLSQVLQNPTMMQMMQNIMSNPQSMNQLLNMNPNVRNMMESNTQLREMFQNPEFLRQLTSPETLQQLISFQQSLMSQLGQQQTGQEHTRSGTSAGNVNLNTLMNMFSGLGAGGGLGVPNAPNVPPEELYATQLAQLQEMGFFDTQENLRALIATAGNVHAAVERLLGNLGQ

SEQ ID NO: 8155 - protein, 234 aa, Panicum virgatum
QATLHIRCTNGSKFAVRADLGATVGAFKAIVAESCDVPAPQQRLIYKGRILKDEQTLASYGVETDHTIHMVRGAAPPLASTAPAANQETSTTAPASSPAAGLGGLLPGLGATGAANSGGLGLFASGLPELDQMQQQLADNPNLMREIMNMPLMQNLMNNPDLIRNIIMNNPQMRELIDRNPDLAHVLNDPSILRQTVEAARNPELMREMMRNTDRAMSNIESSPERFQHAPSHV

SEQ ID NO: 8156 - protein, 534 aa, Oryza sativa
MSGGDGEEAAAAAAAATLHIRCTNGSKLAVRADLGLSVGAFKAIVAESCDVPAPQQRLIYKGRILKDEQTLASYGVETDHTIHMVRGAAPPPASTAPPAANNVTPAINATTASNSPAVGFGGLLHGLGGSGSANSGGLGSFGSGLPELSQMQQQLSENPTLMREIMNMPLMQNILNSPDLIRNIIMNNPQMREIVDRNPDLAHVLNDPSILRQTVEAARNPELMREMMRNTDRAMSNIESSPEGFNMLRRMYETVQEPFLNATTMAGEGDRSSNPFSALLGNHGSNQARDPAANSPTTTSESTTGSPAPNTNPLPNPWSTTAGAAQGATRPSPVTNARSATAGGLGGLSSTDLGGMLGGGSDTSFLSQVLQNPTMMQMMQNIMSNPQSMNQLLNINPNVRNMMESNTQLREMFQNPEFVRQLTSPETLQQLISFQQSLMSQLGQQQAGPERTQSGAGAGNTNLNNLMSMFSGLGAGGGLGVPSAPNVPPEELYATQLAQLQEMGFFDTQENIRALIATAGNVHAAVERLLGNIG

SEQ ID NO: 8157 - protein, 534 aa, Brachypodium distachyon
MGGGEGEGGESAGAPPATLHIRGASGNKFAVQADLGTTVGAFKAIVAQSCDVPAPQQRLIYKGRILKDEQTLASYGVETDHTIHMVRGAAPPATAAPPAAVNHGTSTTTPSNTPAAGLGGLLQGLGATGTAGTGLGFPGTGLAGLEQMQQQLTENPNLMREILNMPAMQSIMNNPDIMRDMIMSNPQMRELIDRNPDLAHVLNDPSILRQTVEAARNPELMREMMRNTDRAMSNIESSPEGFNMLRRMYETVQEPLLNATTMAGEGDRNSNPFAALLGNQGSNQARDPAGNAPTTASESTTGSPAPNTNPLPNPWSANAGPAQGAARPSPASNARSATSGGLGLGGLGSADLGNMLGGGSDASFLNQVLQNPTMMQMMQNIMSNPQSMNQLLNMNPNVRNMMESNSQMREMFQNPEFLRQLTSPETLQQLISFQQAMTSQLGQQQAGQERTQAGTGAGNVNLNTLMNMFSGLGAGGGLGVPNAPNVPPEELYATQLAQLQEMGFFDPQENIRALVATAGNVNAAVERLLGNFGQ

SEQ ID NO: 8158 - protein, 532 aa, Brachypodium distachyon
MGGDEGEGGESTGAPPATLHIRGASGNKFAVQADLGTTVGAFKAIVAQSCDVPAPQQRLIYKGRILKDEQTLASYGVDTDHTIHMVCGAAPPATAAAPAAANHGTSTTTTANTSPAGLGGLLQGLGATGTAGTGLGLPGSGLAGLEQMQQQLTENPNLMREILNMPAMQSLMNNPDIMRDMIMNNPQMRELIDRNPDLAHVLNDPSILRQTVEAARNPELMREMMRNTDRAMSNIESSPEGFNMLRRMYETVQEPFLNATTMAGEGDRNPNPFAALLGNQGSNQARDPAGNAPTTASESTTGSPAPNTNPLPNPWSANAGSAQGAARPSPASNARSATSGGLGLGGLGSADLGSMLAGGSDASFLNQVLQNPTMMQMMQNIMSNPQSMNQLLNMNPNVRNMMESNSQMREMFQNPEFLRQLTSPETLQQLISFQQAMTSQLGQQQAGQERTQAGTGAGNVNLNTLMNMFSGLGGGLGVPNAPNVPPEELYATQLAQLQEMGFFDPQENIRALVATAGNVNAAVERLLGNFGQ

SEQ ID NO: 8159 - protein, 1018 aa, Setaria italica
MAVAGPAPAPLLRCRGSAPPWFASSSPFFSRRRARRSSPPPALSGCRRQNYSHSSDMEVRGSSTFKLGFYANLNVQNIAQEWLVESRRLFYLRTVNSVTNNIFKGTTPLRAENLQNELSEDRRGLNHPSLHNLREFISSKSIVNRHENTELVRHSMINHVQSVFPVSAVNNSVKQSMPRGPNVTLRDISNTEAVLELDDKVHDGDDKKVKKPVVKKWVSSLPPKASFSEESVKARKALAGIYNKVLVVDNIESARTIVQLLTTKYKNFIHACDTEVSNINVKEETPVGHGHVTCFSIYSANSNAQVADFGNGKTCIWVDVLDGGRDVLMEFAPFFEDPSIKKVWHNYSFDSHVIENHGIKVAGFHADTMHLARLWDSSRKTDGGYSLEGLTNDRRVMDAVLEDLPNAGKTSMKTIFGRKKVRKDGSEGKVISVDPVEKLQREDKELWICYSSLDSMSTLRLYESLKRKLETKEWIFDGCPRGTMYDFYEEYWRPFGAILVKMETEGMLVDRGYLSEIEKAAIAEREVAANKFRKWASKYCPDAKYMNVNSDTQIRQLLFGGIENRHKSGETWPLSKTFKVPNEETVDTEGKKTSKYRTIKLCSIVEDLKIDMFTPSGWPSVSGDALRSLAGKIPTEHIYTMDDCDEDSSGSEDPEQEIDENSSYGTAYEAFGGGKKGKEACHAIAALCEICSIDSLISNFILPLQGDHISCAEGRIHCSLNINTETGRLSARTPNLQNQPALEKDRYKIRQAFVAAPGNSLIVADYGQLELRILAHLTNCKSMLDAFKAGGDFHSRTAMNMYQHIRDAVDEKKVLLEWHPQPGQEKPPVPLLKDAFGAERRKAKMLNFSIAYGKTAVGLSRDWKVSVKEARDTLKLWYGDRKEVLAWQKRQKKLAHEKCEVYTLLGRSRRFPNLTQFGPGQRGHIERAAINAPVQGSAADVAMCAMLEIERDTRLKELGWRLLLQVHDEVILEGPSESAETAKAIVVECMSKPFYGTNILNVDLAVDAKCAKSWYAAK

SEQ ID NO: 8160 - protein, 1023 aa, Panicum virgatum
MAVAAQAPVPLLRCRGSAPPWLSSSSHFFLRRRARRSSPPPALSGCRRQDYSHSSDMGVRESSAFKLGFYANLNVPNIAQEWLVESRRLFYLRTINSVTNNIYKGTTPRRAGNLQSELSEDCRGLNYPSLHNIREHVSPKSIVNRHENTELVRHSMINQSVQSVFPVSIVNNSVKQSMPRGPNVGIPLHDISNTEVILELDDKVHDGKDKVKKLVVKKRVSSLPTKASFSKESMEARKEVAAIYDKVLVVDSMESARTIVQLLTTKYKNFIHACDTEEANIDVKDETPVGHGQVTCFSICSANSNAQVADFGNGKTCIWVDVLDGGRDVLMEFAPFFEDPSIKKVWHNYSFDSHVIENHGIKVAGFHADTMHLARLWDSSRRTDGGYSLEGLTNDCRVMDAAPKDLPNAGKTSMKTIFGKKNVKKDGSEGKVISVDPVEKLQREDRELWICYSSLDSMSTLRLYESFKRKLETKEWIFDGCPRGTMYDFYEEYWRPFGALLVKMETEGMLVDRGYLSEIEKAAIAEREVAANKFRKWASKYCPDAKYMNVNSDTQIRQLLFGGIENRHKSGATWHHSKTFKVPNEESVDTEGKKTSKYRTIKLCSIVEDLKIDMFTPSGWPSVSADALRSLAGKIPTEHIYTIDGIEGGEEDTSGSEHSEQEVDESSSYGTAYEAFGGGKKGKEACNAIAALCEICSIDSLISNFILPLQGDHISCAEGRIHCSLNINTETGRLSARTPNLQNQPALEKDRYKIRQAFVAAPGNSLIVADYGQLELRILAHLANCKSMLDAFKAGGDFHSRTAMNMYQHIRDAVDENKVLLEWHPQPGQEKPPVPLLKDAFGAERRKAKMLNFSIAYGKTAVGLSRDWKVSVKEARDTLKLWYGDRKEVLAWQKRQKKLAHEKCEVYTLLGRSRRFPNLTQFGPGQRGHIERAAINAPVQGSAADVAMCAMLEIERNTRLKELGWRLLLQVHDEVILEGPSDSAETAKAIVVECMSKPFYGINILNVDLAVDAKCAKSWYAAK

SEQ ID NO: 8161 - protein, 275 aa, Saccharum officinarum
MDDIAGQPGRKGDDSSRAVLTPPPRGPSLLSPSSPPSGSGPIPSPPSAAVLALPASAASQSAGLLASSRLAGEMDGGGETLLVRRSKGKKKRPQPAAPAERGSGGSGDRFRTLWRDYHDLLQETEAKKKRLASTKRRSLALLAEVKFLRSKYQSFLKGGSQQKHYKLKKQAWYTPSPLGSNKTTALADHGAGTEVPSTSKNPNVDLNQDSVPNDAGNDRQGQQGHPEVEKFDQVTVDEDMMTADVKLSVCRDTGNSPASEGKRAVPWQDRLALKA

SEQ ID NO: 8162 - protein, 276 aa, Sorghum bicolor
MDDIAGEPGRKGDDSSRAVLTPPPRGPGLLSPSSPPSGSGPIPSPPSAAAAAVLALPASATSQGAGLLASSRLAGEMDGGGETLLVRRSKGKKKRPQPAAERGSGGSGDRFRTLWRDYHDLLQETEGKKKMLASTKRRSLALLAEVKFLRRKYQSFLKGGSQQKHYKLKKQARYMPSPLGSNKATALGDHGARTKVPSTSKNSNLHLNQDSVPNDVVNDHQGQQGHPEVEKFDEVGVDEDMMTPDVKLSVCRDTGNSPASEGKRTVPWQDRLALKA

SEQ ID NO: 8163 - protein, 263 aa, Zea mays
MDDIAGERGRKGDDSSRAVLTPPRGPGLLSPSSPSRSDPIPSPPSAAVLALPAAATSPSAGLLASSRLTGEMDGGGETLLVRRSKGKKRRQPAAPAERGSGSGDRFRALWRDYHDLLQETEAKKRRLASKKRRSLALLAEVKFLRRKYQSFPKGGSQQTHYRLKKQARYMPSPLGHGAGTEVPSTSRNPNLDLNQDSVLNDVGNDCQGQHGHPEVEKLDQVEVNEDTMTPDVKLSVCRDTGEYSPVSEGKRAVPWQDRFALKT

SEQ ID NO: 8164 - protein, 534 aa, Setaria italica
MAEPGKVVRRWQRWAFANLGSAFTNFGSLWFILAPLVSLVATYAPRRLFQTYFNLFLRRRTRRVLNVVDPYVTIDISEPGSDVRYSRYGPVSDNDGTYEEVKAYLSGACSHEDARELRAEGAKDGDGLVISMRDGQDVADEFRGVPLWWSSVVDKDVQGQRQGKRRFQRLTFHLRHRRLVVDEYLPHVRRRGREILFSNRRRRLYTNSKSRDVYSYESKSWSYIDFDHPTTFNTLAMDRAKKKDIMDDLDAFRNNRDFYRRTGKPWKRGYLLYGPPGTGKSTMVAAMANYLDYDIYDVELTVVNTNTDLRRLLIETTSKSIIVIEDIDCSLDLTGDRARQRRRPGGPPKDDDRYYADDRPRNTVTLSGLLNFIDGLWSASGGERIVVFTTNHVDKLDPALIRRGRMDMHIEMSYCGFEAFQTLAKNYLDIDDHELFGSVEEILREVKLTPADVAECLMTAKRAGAGEPSPCLEILIDELKKRAEEKEKAEAEAKAKAEAEAKAWAEAEAKAAAEAEAKAAAEANASEMARGNTR

SEQ ID NO: 8165 - protein, 356 aa, Setaria italica
MDVEARKDAAPARGKAMRRLLVALNCGMLALGAIGGPLLSRLYFSKGGHRQWLSAWLETAGWPLLLVPVVAAYVARRARDRAAPALLTPPRILLAAVGLGVATGVDDFIYAYGLSYLPVSTSAILISTQLAFTVLFAFLIVRQRLTAASVNAVALLTVGAVVLGLHVSSDRPPGVTRGQYWLGFILTLGAAALYGLVLPLVELAYRRAAGGGRAVTYALVIEMQLVMGFFATAFCTVGMIVNKDFQAIPREAKHFELGEARYYTVLVWSAVLWQCFFLGAVGVIFCVHTLLAGILIAVFIPVTEVAAVIFLHEKFSSEKGVALVLSLWGLASYSYGEWSDSRAKKKAEAAAEGQAS

SEQ ID NO: 8166 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 8167 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 8168 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 8169 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 8170 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 8171 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 8172 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 8173 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 8174 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 8175 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 8176 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 8177 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 8178 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 8179 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 8180 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 8181 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 8182 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 8183 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 8184 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 8185 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 8186 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 8187 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 8188 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 8189 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 8190 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 8191 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 8192 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 8193 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 8194 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 8195 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 8196 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 8197 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 8198 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 8199 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 8200 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 8201 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 8202 - DNA, 538 bp, 35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 8203 - DNA, 555 bp, Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 8204 - DNA, 31 bp, Artificial Sequence
  Primer
aaagaattccctcctcttctagggtttcctc

SEQ ID NO: 8205 - DNA, 32 bp, Artificial Sequence
  Primer
aaaggatccggtacatagcaaaacatggctcc

SEQ ID NO: 8206 - DNA, 31 bp, Artificial Sequence
  Primer
aaaggatcctacacatagcttcggaatcacg

SEQ ID NO: 8207 - DNA, 29 bp, Artificial Sequence
  Primer
aaagaattcctggtctcgtctctcccatc

SEQ ID NO: 8208 - DNA, 30 bp, Artificial Sequence
  Primer
aaaggatcccaagcaacgaagccagattag

SEQ ID NO: 8209 - DNA, 28 bp, Artificial Sequence
  Primer
aaaggatccagctcgactctcgccaaac

SEQ ID NO: 8210 - DNA, 29 bp, Artificial Sequence
  Primer
aaaggatccacactcgcactccacaagac

SEQ ID NO: 8211 - DNA, 29 bp, Artificial Sequence
  Primer
aaaggatccattgcaacttgagcgagcac

SEQ ID NO: 8212 - DNA, 29 bp, Artificial Sequence
  Primer
aaacccggggcaaatcgagtgagcatgag

SEQ ID NO: 8213 - DNA, 30 bp, Artificial Sequence
  Primer
aaaggatccggttagtcgttcgtttgcttg

SEQ ID NO: 8214 - DNA, 29 bp, Artificial Sequence
  Primer
aaaggatccattccgaatcccatttctcc

SEQ ID NO: 8215 - DNA, 29 bp, Artificial Sequence
  Primer
aaaggatccctcctaaacctcctccgctc

SEQ ID NO: 8216 - DNA, 26 bp, Artificial Sequence
  Primer
aaaggatcccaaccagcaccccagca

SEQ ID NO: 8217 - DNA, 30 bp, Artificial Sequence
  Primer
aaaaggcctcttactctcctagcccgttcg

SEQ ID NO: 8218 - DNA, 31 bp, Artificial Sequence
  Primer
aaaggatccaaccctagcctagcctaccctc

SEQ ID NO: 8219 - DNA, 30 bp, Artificial Sequence
  Primer
aaaggatccaatcaatcccaacctccactg

SEQ ID NO: 8220 - DNA, 27 bp, Artificial Sequence
  Primer
aaaggatccggaggctggtccatcgag

SEQ ID NO: 8221 - DNA, 31 bp, Artificial Sequence
  Primer
aaaggatccggctctattggctttcctcaag

SEQ ID NO: 8222 - DNA, 27 bp, Artificial Sequence
  Primer
aaagatatcagccaccggaaacgaaac

SEQ ID NO: 8223 - DNA, 29 bp, Artificial Sequence
  Primer
aaaggatccaactgagcaaaccctccctc

SEQ ID NO: 8224 - DNA, 30 bp, Artificial Sequence
  Primer
aaaggatccacacaaccatcaagatcggag

SEQ ID NO: 8225 - DNA, 29 bp, Artificial Sequence
  Primer
aaagaattcaagccaaacaccatctccac

SEQ ID NO: 8226 - DNA, 30 bp, Artificial Sequence
  Primer
aaaggatccattgacagcccaccttagcag

SEQ ID NO: 8227 - DNA, 27 bp, Artificial Sequence
  Primer
aaaggatccagaaacagaaggggccgt

SEQ ID NO: 8228 - DNA, 31 bp, Artificial Sequence
  Primer
aaaggatcccttcggaagagaccaattcttg

SEQ ID NO: 8229 - DNA, 32 bp, Artificial Sequence
  Primer
aaagaattccatataatttccttctccgctgg

SEQ ID NO: 8230 - DNA, 31 bp, Artificial Sequence
  Primer
aaagaattctctttcattcggctttgatctg

SEQ ID NO: 8231 - DNA, 27 bp, Artificial Sequence
  Primer
aaaggatccgactcgccggtttgtttc

SEQ ID NO: 8232 - DNA, 28 bp, Artificial Sequence
  Primer
aaagaattcaccctaggcaacaaggcag

SEQ ID NO: 8233 - DNA, 28 bp, Artificial Sequence
  Primer
aaaggatccgcgttcgctcaaactcaag

SEQ ID NO: 8234 - DNA, 31 bp, Artificial Sequence
  Primer
aaacccgggttcctctactgctgctacctcg

SEQ ID NO: 8235 - DNA, 31 bp, Artificial Sequence
  Primer
aaagaattccgagtagttgagcagtagcagc

SEQ ID NO: 8236 - DNA, 30 bp, Artificial Sequence
  Primer
aaacccgggctaacggcgaagctctctagc

SEQ ID NO: 8237 - DNA, 30 bp, Artificial Sequence
  Primer
aaaggatccaaataaacgcagagccgagag

SEQ ID NO: 8238 - DNA, 25 bp, Artificial Sequence
  Primer
aaaggatccagagcaacgcgagcca

SEQ ID NO: 8239 - DNA, 31 bp, Artificial Sequence
  Primer
aaaggatccataacgttgcttgctcttgctc

SEQ ID NO: 8240 - DNA, 27 bp, Artificial Sequence
  Primer
aaaggatcccgcagatctccgaccaac

SEQ ID NO: 8241 - DNA, 26 bp, Artificial Sequence
  Primer
aaaggatccattttgtcggcggcaag

SEQ ID NO: 8242 - DNA, 28 bp, Artificial Sequence
  Primer
aaaggatcctctgctctgttcgccattg

SEQ ID NO: 8243 - DNA, 32 bp, Artificial Sequence
  Primer
aaagaattcaatctcactcctggtgctactcc

SEQ ID NO: 8244 - DNA, 27 bp, Artificial Sequence
  Primer
aaagatatcagaaacgtcgcttcctcg

SEQ ID NO: 8245 - DNA, 29 bp, Artificial Sequence
  Primer
aaaggatccgagactcctcccaccgaatc

SEQ ID NO: 8246 - DNA, 31 bp, Artificial Sequence
  Primer
aaagaattcagtggcatttgtccctactctc

SEQ ID NO: 8247 - DNA, 29 bp, Artificial Sequence
  Primer
aaagaattcctccgctcacactgacacac

SEQ ID NO: 8248 - DNA, 29 bp, Artificial Sequence
  Primer
aaagatatcaccagcttcactggctcaac

SEQ ID NO: 8249 - DNA, 31 bp, Artificial Sequence
  Primer
aaacccgggaaagcctctgctcttgtgtctc

SEQ ID NO: 8250 - DNA, 29 bp, Artificial Sequence
  Primer
aaacccgggattcgttcgtggtccctctc

SEQ ID NO: 8251 - DNA, 31 bp, Artificial Sequence
  Primer
aaagaattcggagtctggtcttcactgtcac

SEQ ID NO: 8252 - DNA, 31 bp, Artificial Sequence
  Primer
aaagaattcgccatctcaagctagctcaaac

SEQ ID NO: 8253 - DNA, 30 bp, Artificial Sequence
  Primer
aaaggatccgcacgctccttcttctagtcc

SEQ ID NO: 8254 - DNA, 28 bp, Artificial Sequence
  Primer
aaaggatccgcctctgggagttggattg

SEQ ID NO: 8255 - DNA, 31 bp, Artificial Sequence
  Primer
aaacccggggggaaggaagagacacaaatcc

SEQ ID NO: 8256 - DNA, 29 bp, Artificial Sequence
  Primer
aaaggatccaagctttgcggaatccctac

SEQ ID NO: 8257 - DNA, 32 bp, Artificial Sequence
  Primer
aaagatatccccaaccctaatctacatacacg

SEQ ID NO: 8258 - DNA, 28 bp, Artificial Sequence
  Primer
aaacccgggaattgaaactccgccttgg

SEQ ID NO: 8259 - DNA, 29 bp, Artificial Sequence
  Primer
aaaggatccatccaatccctctcgtcctc

SEQ ID NO: 8260 - DNA, 31 bp, Artificial Sequence
  Primer
aaagatatcacagtagtgttgtgttggcagc

SEQ ID NO: 8261 - DNA, 25 bp, Artificial Sequence
  Primer
aaagaattcagcacaatgcgcctcg

SEQ ID NO: 8262 - DNA, 28 bp, Artificial Sequence
  Primer
aaaggatccacaagaaccgcgtcaacac

SEQ ID NO: 8263 - DNA, 28 bp, Artificial Sequence
  Primer
aaaggatcccgtctcgctgaattggttg

SEQ ID NO: 8264 - DNA, 30 bp, Artificial Sequence
  Primer
aaaggatccaaactcctctcttgcccattg

SEQ ID NO: 8265 - DNA, 31 bp, Artificial Sequence
  Primer
aaaggatccctccactccaagaacagcaaag

SEQ ID NO: 8266 - DNA, 28 bp, Artificial Sequence
  Primer
aaagaattcaatcgatcgaaagcggaag

SEQ ID NO: 8267 - DNA, 29 bp, Artificial Sequence
  Primer
aaaggatcctcagagagaccaaggcaagg

SEQ ID NO: 8268 - DNA, 26 bp, Artificial Sequence
  Primer
aaagaattcctgccgcggtaccctat

SEQ ID NO: 8269 - DNA, 33 bp, Artificial Sequence
  Primer
aaaggatccggcatctactactactcctcccac

SEQ ID NO: 8270 - DNA, 31 bp, Artificial Sequence
  Primer
aaaggatcccgaagccaacatctagtcaagg

SEQ ID NO: 8271 - DNA, 27 bp, Artificial Sequence
  Primer
aaacccgggaagaacaagcgagcgtgg

SEQ ID NO: 8272 - DNA, 29 bp, Artificial Sequence
  Primer
aaacccgggtcaccgctctggaaattcac

SEQ ID NO: 8273 - DNA, 29 bp, Artificial Sequence
  Primer
aaaggatcccatcagccagccactaggtc

SEQ ID NO: 8274 - DNA, 32 bp, Artificial Sequence
  Primer
aaaggatcccctcccatctaaagctttctagc

SEQ ID NO: 8275 - DNA, 28 bp, Artificial Sequence
  Primer
aaaggatccgccgcatttattcccttcc

SEQ ID NO: 8276 - DNA, 28 bp, Artificial Sequence
  Primer
aaaggatccccggctctcacctcaaatc

SEQ ID NO: 8277 - DNA, 27 bp, Artificial Sequence
  Primer
aaaggatcccaaccatgcagcgaaaga

SEQ ID NO: 8278 - DNA, 31 bp, Artificial Sequence
  Primer
aaaggatcccatggccattccttctctactg

SEQ ID NO: 8279 - DNA, 31 bp, Artificial Sequence
  Primer
aaagaattcaaagcggtagaaaggtgtgatg

SEQ ID NO: 8280 - DNA, 30 bp, Artificial Sequence
  Primer
aaaggatccgtgtgatagctgctgctcttg

SEQ ID NO: 8281 - DNA, 30 bp, Artificial Sequence
  Primer
aaaggatccactcggtaaaccattcccctc

SEQ ID NO: 8282 - DNA, 31 bp, Artificial Sequence
  Primer
aaaggatccactcggcagatttcactgactc

SEQ ID NO: 8283 - DNA, 26 bp, Artificial Sequence
  Primer
aaagaattcacagccgacaaggcagg

SEQ ID NO: 8284 - DNA, 31 bp, Artificial Sequence
  Primer
aaagaattcattctcgaggctccttctcttg

SEQ ID NO: 8285 - DNA, 31 bp, Artificial Sequence
  Primer
aaaggatccctagatttgcaggcagttgagc

SEQ ID NO: 8286 - DNA, 29 bp, Artificial Sequence
  Primer
aaaggatccaaagaaaagagcagcggagc

SEQ ID NO: 8287 - DNA, 27 bp, Artificial Sequence
  Primer
aaaggatcccatttcgtcgaacgccag

SEQ ID NO: 8288 - DNA, 31 bp, Artificial Sequence
  Primer
aaaaggcctcagtcactgttcacacaacagc

SEQ ID NO: 8289 - DNA, 31 bp, Artificial Sequence
  Primer
aaaggatccaaggctacgtgctggtttacag

SEQ ID NO: 8290 - DNA, 30 bp, Artificial Sequence
  Primer
aaaggatccagtgctctgctttctgcattc

SEQ ID NO: 8291 - DNA, 27 bp, Artificial Sequence
  Primer
aaaggatccagcgctctttgcatctcc

SEQ ID NO: 8292 - DNA, 32 bp, Artificial Sequence
  Primer
aaagaattcttaaggttaagcacctcccaaac

SEQ ID NO: 8293 - DNA, 28 bp, Artificial Sequence
  Primer
aaaggatccgcccagagaagatcccaac

SEQ ID NO: 8294 - DNA, 28 bp, Artificial Sequence
  Primer
aaagaattcacatgcccagagtcacgtc

SEQ ID NO: 8295 - DNA, 31 bp, Artificial Sequence
  Primer
aaagaattcaactgaggaaacgtctcgaatg

SEQ ID NO: 8296 - DNA, 27 bp, Artificial Sequence
  Primer
aaaggatccgacacgctacggcctctc

SEQ ID NO: 8297 - DNA, 31 bp, Artificial Sequence
  Primer
aaaggatcctctgtactccttcctcagcctc

SEQ ID NO: 8298 - DNA, 30 bp, Artificial Sequence
  Primer
aaaggatccgcacatacgcagctacctcac

SEQ ID NO: 8299 - DNA, 30 bp, Artificial Sequence
  Primer
aaaggatccgttcactggataattcgctcg

SEQ ID NO: 8300 - DNA, 30 bp, Artificial Sequence
  Primer
aaaggatccggagagcccagtgaaacagag

SEQ ID NO: 8301 - DNA, 29 bp, Artificial Sequence
  Primer
aaaggatccgatcttcttccagctcgctc

SEQ ID NO: 8302 - DNA, 29 bp, Artificial Sequence
  Primer
aaaggatccagagccgatcagaccatttg

SEQ ID NO: 8303 - DNA, 29 bp, Artificial Sequence
  Primer
aaaggatccgttagctctggctctcctgc

SEQ ID NO: 8304 - DNA, 27 bp, Artificial Sequence
  Primer
aaaggatcctaacgcaatcgctcgctc

SEQ ID NO: 8305 - DNA, 31 bp, Artificial Sequence
  Primer
aaaggatcccttctagaacccaccaccttcc

SEQ ID NO: 8306 - DNA, 28 bp, Artificial Sequence
  Primer
aaaggatcctagcacgccagatcaccag

SEQ ID NO: 8307 - DNA, 31 bp, Artificial Sequence
  Primer
aaagaattcgcctatatatgcagcgtgatgg

SEQ ID NO: 8308 - DNA, 29 bp, Artificial Sequence
  Primer
aaacccgggcggattcttcctgctgagtc

SEQ ID NO: 8309 - DNA, 29 bp, Artificial Sequence
  Primer
aaagaattcacaagaagccgggagagatg

SEQ ID NO: 8310 - DNA, 30 bp, Artificial Sequence
  Primer
aaaggatccgcaacgcgtctctctgtaaac

SEQ ID NO: 8311 - DNA, 25 bp, Artificial Sequence
  Primer
aaagaattccagccgtggcgagatg

SEQ ID NO: 8312 - DNA, 28 bp, Artificial Sequence
  Primer
aaaggatccctgactggtgcgcgtttag

SEQ ID NO: 8313 - DNA, 27 bp, Artificial Sequence
  Primer
aaaggatcccttcctcgcattcgcatc

SEQ ID NO: 8314 - DNA, 29 bp, Artificial Sequence
  Primer
aaagatatcgttcagtccagcaacccttg

SEQ ID NO: 8315 - DNA, 28 bp, Artificial Sequence
  Primer
aaaggatccaccacgagtcctccacctc

SEQ ID NO: 8316 - DNA, 28 bp, Artificial Sequence
  Primer
aaaaggcctccctcggtttctgcttgtc

SEQ ID NO: 8317 - DNA, 29 bp, Artificial Sequence
  Primer
aaaggatccgactccaacccaatccaatg

SEQ ID NO: 8318 - DNA, 31 bp, Artificial Sequence
  Primer
aaagatatctactatctcctcccgtctcgtg

SEQ ID NO: 8319 - DNA, 28 bp, Artificial Sequence
  Primer
aaaggatccctgcgatggcatctagagg

SEQ ID NO: 8320 - DNA, 30 bp, Artificial Sequence
  Primer
aaaggatccagtgaagtgtggaggcgaatc

SEQ ID NO: 8321 - DNA, 31 bp, Artificial Sequence
  Primer
aaaggatcccaccaccattaacgcttaaacc

SEQ ID NO: 8322 - DNA, 28 bp, Artificial Sequence
  Primer
aaaggatcccgatacgatgaggccactc

SEQ ID NO: 8323 - DNA, 34 bp, Artificial Sequence
  Primer
aaaggatcccgtgtactacttcgtgatattggtg

SEQ ID NO: 8324 - DNA, 31 bp, Artificial Sequence
  Primer
aaaggatcctacaactcctccatcccaattc

SEQ ID NO: 8325 - DNA, 30 bp, Artificial Sequence
  Primer
aaaggatccgagaagaagaagcccatccac

SEQ ID NO: 8326 - DNA, 28 bp, Artificial Sequence
  Primer
aaaggatccccctgctcactcacattgg

SEQ ID NO: 8327 - DNA, 31 bp, Artificial Sequence
  Primer
aaagaattccagtgcccaacacagacaatac

SEQ ID NO: 8328 - DNA, 31 bp, Artificial Sequence
  Primer
aaaggatccctcaccttcctcaaaccctagc

SEQ ID NO: 8329 - DNA, 34 bp, Artificial Sequence
  Primer
aaaggatcctccacagctaccactattacacacc

SEQ ID NO: 8330 - DNA, 31 bp, Artificial Sequence
  Primer
aaaggatcctatccctccgttaactctccag

SEQ ID NO: 8331 - DNA, 28 bp, Artificial Sequence
  Primer
aaaggatcctaacacgagcagccacagc

SEQ ID NO: 8332 - DNA, 31 bp, Artificial Sequence
  Primer
aaaggatccaacaaggcaagtcacccactac

SEQ ID NO: 8333 - DNA, 29 bp, Artificial Sequence
  Primer
aaaggatccccagtctcttcctccattgc

SEQ ID NO: 8334 - DNA, 29 bp, Artificial Sequence
  Primer
aaaggatccgcttctgcttcagtgcttcc

SEQ ID NO: 8335 - DNA, 28 bp, Artificial Sequence
  Primer
aaagatatcgtcccgacaggaatccaac

SEQ ID NO: 8336 - DNA, 31 bp, Artificial Sequence
  Primer
aaaggatcccattgatcattgagcattcagc

SEQ ID NO: 8337 - DNA, 36 bp, Artificial Sequence
  Primer
aaaggatccaagaagatggacttactggagttatgg

SEQ ID NO: 8338 - DNA, 31 bp, Artificial Sequence
  Primer
aaaggatcccttcataactaaaccgccatcg

SEQ ID NO: 8339 - DNA, 31 bp, Artificial Sequence
  Primer
aaaggatcctgaaagaagaatggtgctttcg

SEQ ID NO: 8340 - DNA, 31 bp, Artificial Sequence
  Primer
aaaggatccccatttacactcactcacgcac

SEQ ID NO: 8341 - DNA, 31 bp, Artificial Sequence
  Primer
aaaggatccacgtacacaaagcaaatcccac

SEQ ID NO: 8342 - DNA, 30 bp, Artificial Sequence
  Primer
aaaggatccgtccgcaatgtatcgatgatg

SEQ ID NO: 8343 - DNA, 32 bp, Artificial Sequence
  Primer
aaacccgggcgatcccatatgtgttgatagtg

SEQ ID NO: 8344 - DNA, 30 bp, Artificial Sequence
  Primer
aaaggatccttcggtgtttgctttagaagg

SEQ ID NO: 8345 - DNA, 31 bp, Artificial Sequence
  Primer
aaaaggccttccaacaagttgtccacatagc

SEQ ID NO: 8346 - DNA, 31 bp, Artificial Sequence
  Primer
aaaggatcccttcccattcatttcttgaagc

SEQ ID NO: 8347 - DNA, 33 bp, Artificial Sequence
  Primer
aaaggatccaaaatcagtcttcaatggcttctc

SEQ ID NO: 8348 - DNA, 33 bp, Artificial Sequence
  Primer
aaaggatccttccatagcagaggaagaagaaag

SEQ ID NO: 8349 - DNA, 31 bp, Artificial Sequence
  Primer
aaagaattctggagtccaatacagacagacg

SEQ ID NO: 8350 - DNA, 31 bp, Artificial Sequence
  Primer
aaagatatcctgctatacgagccagtacgag

SEQ ID NO: 8351 - DNA, 31 bp, Artificial Sequence
  Primer
aaaggatcctgttcagcgtctcttctctgtg

SEQ ID NO: 8352 - DNA, 31 bp, Artificial Sequence
  Primer
aaaaggccttacaccacaccctgacaaactc

SEQ ID NO: 8353 - DNA, 34 bp, Artificial Sequence
  Primer
aaagaattcctatgttacaggaaggtgtccactg

SEQ ID NO: 8354 - DNA, 31 bp, Artificial Sequence
  Primer
aaaggtacctcattccaatttctctgcactc

SEQ ID NO: 8355 - DNA, 31 bp, Artificial Sequence
  Primer
aaaaggcctttggagaaataactcgagggac

SEQ ID NO: 8356 - DNA, 31 bp, Artificial Sequence
  Primer
aaagaattcattctcgtaacctcaacccagg

SEQ ID NO: 8357 - DNA, 31 bp, Artificial Sequence
  Primer
aaaaggcctagacgttgcccagttaacattc

SEQ ID NO: 8358 - DNA, 31 bp, Artificial Sequence
  Primer
aaagaattctaattctctgcacaccaacacg

SEQ ID NO: 8359 - DNA, 31 bp, Artificial Sequence
  Primer
aaagaattcatcacatcactgctgggtgtag

SEQ ID NO: 8360 - DNA, 31 bp, Artificial Sequence
  Primer
aaagaattcgatctgtgcaaatgaccacaag

SEQ ID NO: 8361 - DNA, 31 bp, Artificial Sequence
  Primer
aaagaattctacttagacgacccagctttcg

SEQ ID NO: 8362 - DNA, 33 bp, Artificial Sequence
  Primer
aaagaattcctatcccaattctgtctcagttgc

SEQ ID NO: 8363 - DNA, 31 bp, Artificial Sequence
  Primer
aaagaattctgcatcccaagtagagtacacg

SEQ ID NO: 8364 - DNA, 33 bp, Artificial Sequence
  Primer
aaagaattcttaagcccgttggcaccaatatta

SEQ ID NO: 8365 - DNA, 31 bp, Artificial Sequence
  Primer
aaaaggcctcacctgctaactgtcacaaagc

SEQ ID NO: 8366 - DNA, 31 bp, Artificial Sequence
  Primer
aaagaattccacatgatccttcatcaccatc

SEQ ID NO: 8367 - DNA, 31 bp, Artificial Sequence
  Primer
aaagaattctccagcaagagagcctcaatac

SEQ ID NO: 8368 - DNA, 31 bp, Artificial Sequence
  Primer
aaagaattctcttgaaacgcatctcacagtc

SEQ ID NO: 8369 - DNA, 31 bp, Artificial Sequence
  Primer
aaagaattccaatgggtctgaatttaggtgg

SEQ ID NO: 8370 - DNA, 33 bp, Artificial Sequence
  Primer
aaagaattcctatgagttcggcattgagctatc

SEQ ID NO: 8371 - DNA, 31 bp, Artificial Sequence
  Primer
aaagaattcaactggagcaacattaggcaag

SEQ ID NO: 8372 - DNA, 34 bp, Artificial Sequence
  Primer
aaagaattcctaaaacttggtaggagggagggag

SEQ ID NO: 8373 - DNA, 31 bp, Artificial Sequence
  Primer
aaaaggcctattcacccagtaagcgaacaag

SEQ ID NO: 8374 - DNA, 31 bp, Artificial Sequence
  Primer
aaagaattcagacggaaataatacacgcagc

SEQ ID NO: 8375 - DNA, 31 bp, Artificial Sequence
  Primer
aaagaattcctgctttcaccacctacctctc

SEQ ID NO: 8376 - DNA, 33 bp, Artificial Sequence
  Primer
aaaggtacccattcagtactcatcatcctttcg

SEQ ID NO: 8377 - DNA, 36 bp, Artificial Sequence
  Primer
aaaaggcctccatcatcaccactagttcttctattg

SEQ ID NO: 8378 - DNA, 32 bp, Artificial Sequence
  Primer
aaaaggcctcgtagtccaaacgaacatacctg

SEQ ID NO: 8379 - DNA, 31 bp, Artificial Sequence
  Primer
aaagaattcgttattacaagggacggcaaag

SEQ ID NO: 8380 - DNA, 39 bp, Artificial Sequence
  Primer
aaaaggcctttaacttgaacctgtactatgaacccaaaa

SEQ ID NO: 8381 - DNA, 31 bp, Artificial Sequence
  Primer
aaaggtaccagaaaccaacagcaatttcgac

SEQ ID NO: 8382 - DNA, 31 bp, Artificial Sequence
  Primer
aaagaattcaccatttgaggtatctggcatc

SEQ ID NO: 8383 - DNA, 31 bp, Artificial Sequence
  Primer
aaaaggcctgaccctttatgcaacctgacac

SEQ ID NO: 8384 - DNA, 34 bp, Artificial Sequence
  Primer
aaaggtaccctacatggtgacgtgcaaataattc

SEQ ID NO: 8385 - DNA, 32 bp, Artificial Sequence
  Primer
aaaggtaccaagaatgttcaacagcgaaacag

SEQ ID NO: 8386 - DNA, 31 bp, Artificial Sequence
  Primer
aaagaattcgccaacatgtgcagcttattac

SEQ ID NO: 8387 - DNA, 34 bp, Artificial Sequence
  Primer
aaagaattcctaacaacgcaatcttctcttcacc

SEQ ID NO: 8388 - DNA, 32 bp, Artificial Sequence
  Primer
aaagaattccacgacagagctagaacttgagg

SEQ ID NO: 8389 - DNA, 31 bp, Artificial Sequence
  Primer
aaagaattccatcaccctccctctacgaaag

SEQ ID NO: 8390 - DNA, 31 bp, Artificial Sequence
  Primer
aaagaattcgtaccttcatcccatgcatttc

SEQ ID NO: 8391 - DNA, 39 bp, Artificial Sequence
  Primer
aaaaggccttgagtacacctgtcttacctagagttcaat

SEQ ID NO: 8392 - DNA, 31 bp, Artificial Sequence
  Primer
aaaggtaccgcaacaacacgttaacacaagg

SEQ ID NO: 8393 - DNA, 31 bp, Artificial Sequence
  Primer
aaagaattcaatggagcaattccacaagttc

SEQ ID NO: 8394 - DNA, 31 bp, Artificial Sequence
  Primer
aaaaggcctcatttcggtttaagattcgctg

SEQ ID NO: 8395 - DNA, 33 bp, Artificial Sequence
  Primer
aaaaggcctttcaacgacattgatttaggcttc

SEQ ID NO: 8396 - DNA, 31 bp, Artificial Sequence
  Primer
aaagaattcaatcctgctgaactcaagcatc

SEQ ID NO: 8397 - DNA, 31 bp, Artificial Sequence
  Primer
aaaggtaccagactcgaccgtacatatgctg

SEQ ID NO: 8398 - DNA, 31 bp, Artificial Sequence
  Primer
aaacccgggtcttaggtcgcttgaattggac

SEQ ID NO: 8399 - DNA, 33 bp, Artificial Sequence
  Primer
aaaaggcctcactggaagcttactgatctctgc

SEQ ID NO: 8400 - DNA, 31 bp, Artificial Sequence
  Primer
aaaaggcctctggagctagttaatcggttgc

SEQ ID NO: 8401 - DNA, 31 bp, Artificial Sequence
  Primer
aaagaattcgagtgctgtgaagagctaggtg

SEQ ID NO: 8402 - DNA, 34 bp, Artificial Sequence
  Primer
aaagaattcctattcaatttggagttcactgctc

SEQ ID NO: 8403 - DNA, 35 bp, Artificial Sequence
  Primer
aaacccgggtcattatttccagtttcatgtaaggg

SEQ ID NO: 8404 - DNA, 32 bp, Artificial Sequence
  Primer
aaagaattcatgatctctggagcagaagactg

SEQ ID NO: 8405 - DNA, 33 bp, Artificial Sequence
  Primer
aaagaattcctacttggcctgaagcaacataac

SEQ ID NO: 8406 - DNA, 31 bp, Artificial Sequence
  Primer
aaaggtaccacaaagacgccctcctattagc

SEQ ID NO: 8407 - DNA, 31 bp, Artificial Sequence
  Primer
aaagatatcaacatcatcagaccagcatcac

SEQ ID NO: 8408 - DNA, 32 bp, Artificial Sequence
  Primer
aaagaattcccagataccacgatttagaccag

SEQ ID NO: 8409 - DNA, 33 bp, Artificial Sequence
  Primer
aaaaggcctatcattctaaccagcatgaaccct

SEQ ID NO: 8410 - DNA, 31 bp, Artificial Sequence
  Primer
aaagaattcaaggctagctcaatgcagaaag

SEQ ID NO: 8411 - DNA, 31 bp, Artificial Sequence
  Primer
aaagaattcgctgcctatgagatctttcctc

SEQ ID NO: 8412 - DNA, 28 bp, Artificial Sequence
  Primer
aaagaattcagttgaacgcacaacgcac

SEQ ID NO: 8413 - DNA, 31 bp, Artificial Sequence
  Primer
aaagaattctgctaccaaacaacagctcaac

SEQ ID NO: 8414 - DNA, 34 bp, Artificial Sequence
  Primer
aaaaggcctctaaacctggacacacccatttatc

SEQ ID NO: 8415 - DNA, 34 bp, Artificial Sequence
  Primer
aaagaattcctaaagtttagagcagtgccgtgtg

SEQ ID NO: 8416 - DNA, 31 bp, Artificial Sequence
  Primer
aaagaattctacaacactttgatgcgaccac

SEQ ID NO: 8417 - DNA, 31 bp, Artificial Sequence
  Primer
aaagaattctgatttgttgttctacgccaag

SEQ ID NO: 8418 - DNA, 31 bp, Artificial Sequence
  Primer
aaagaattcacccgatctcggttatatggtc

SEQ ID NO: 8419 - DNA, 31 bp, Artificial Sequence
  Primer
aaaggtacctccctttggatgagaatacctg

SEQ ID NO: 8420 - DNA, 31 bp, Artificial Sequence
  Primer
aaagaattcgctgggagaggcaagtatacag

SEQ ID NO: 8421 - DNA, 31 bp, Artificial Sequence
  Primer
aaaggtaccaatacagtgcagcacacgagtc

SEQ ID NO: 8422 - DNA, 31 bp, Artificial Sequence
  Primer
aaagaattcagtcaccaaaggaatgaacagg

SEQ ID NO: 8423 - DNA, 31 bp, Artificial Sequence
  Primer
aaagaattcatgtgtacccaagacatgatcg

SEQ ID NO: 8424 - DNA, 31 bp, Artificial Sequence
  Primer
aaagatatctggattgcgtaccttgactatg

SEQ ID NO: 8425 - DNA, 31 bp, Artificial Sequence
  Primer
aaagaattctgatcttcaaaggcaacggtag

SEQ ID NO: 8426 - DNA, 31 bp, Artificial Sequence
  Primer
aaagaattcgaaagcagaactacgcacacag

SEQ ID NO: 8427 - DNA, 30 bp, Artificial Sequence
  Primer
aaaaggcctccagttgcctccaacatacag

SEQ ID NO: 8428 - DNA, 31 bp, Artificial Sequence
  Primer
aaagaattctacaacatgcaaatgggaagtg

SEQ ID NO: 8429 - DNA, 31 bp, Artificial Sequence
  Primer
aaagaattctactcagaattgcaggagatgc

SEQ ID NO: 8430 - DNA, 31 bp, Artificial Sequence
  Primer
aaagaattccacggctacttgttacatcagc

SEQ ID NO: 8431 - DNA, 36 bp, Artificial Sequence
  Primer
aaagagctcctagcaaaattggtttacaagaaccac

SEQ ID NO: 8432 - DNA, 31 bp, Artificial Sequence
  Primer
aaaaggcctcctctggtcttctgactgatcg

SEQ ID NO: 8433 - DNA, 36 bp, Artificial Sequence
  Primer
aaagaattcattaaagcagcagatacaaacaaacac

SEQ ID NO: 8434 - DNA, 31 bp, Artificial Sequence
  Primer
aaagaattctacaaggaccagcaatcatgtc

SEQ ID NO: 8435 - DNA, 28 bp, Artificial Sequence
  Primer
aaagaattccaaacgcttcgcttctcag

SEQ ID NO: 8436 - DNA, 31 bp, Artificial Sequence
  Primer
aaagagctctgcaaatagggcatctagcaac

SEQ ID NO: 8437 - DNA, 33 bp, Artificial Sequence
  Primer
aaaggtaccaagcatattcaatcctcgtttcac

SEQ ID NO: 8438 - DNA, 33 bp, Artificial Sequence
  Primer
aaagaattcgtgctgtttacaccactagagagc

SEQ ID NO: 8439 - DNA, 31 bp, Artificial Sequence
  Primer
aaagaattcaaattcccgcctcaactatctg

SEQ ID NO: 8440 - DNA, 34 bp, Artificial Sequence
  Primer
aaagagctcgttcatgaagacacagcatttattg

SEQ ID NO: 8441 - DNA, 31 bp, Artificial Sequence
  Primer
aaagaattcgccacagacggactttctactc

SEQ ID NO: 8442 - DNA, 28 bp, Artificial Sequence
  Primer
aaaaggccttccacaatgacccgttagc

SEQ ID NO: 8443 - DNA, 36 bp, Artificial Sequence
  Primer
aaaaggccttcaggtgtcacatatattcaggataag

SEQ ID NO: 8444 - DNA, 31 bp, Artificial Sequence
  Primer
aaagaattccgagccaaacaagttacatgac

SEQ ID NO: 8445 - DNA, 31 bp, Artificial Sequence
  Primer
aaagaattcaactttcatgagcgcaagctac

SEQ ID NO: 8446 - DNA, 31 bp, Artificial Sequence
  Primer
aaagagctcctgcaccatattcagtgtgtcc

SEQ ID NO: 8447 - DNA, 35 bp, Artificial Sequence
  Primer
aaagaattcctagcctttggacgttattcctattg

SEQ ID NO: 8448 - DNA, 33 bp, Artificial Sequence
  Primer
aaagaattcgcacatacacgtagctgaaacatc

SEQ ID NO: 8449 - DNA, 31 bp, Artificial Sequence
  Primer
aaaaggcctaccgctggactttatacacacg

SEQ ID NO: 8450 - DNA, 31 bp, Artificial Sequence
  Primer
aaagaattcgcatgctaacccgtcactaatc

SEQ ID NO: 8451 - DNA, 31 bp, Artificial Sequence
  Primer
aaagaattcattcacctctcagcgacatagc

SEQ ID NO: 8452 - DNA, 31 bp, Artificial Sequence
  Primer
aaagaattctagctaccttctttcacggtgc

SEQ ID NO: 8453 - DNA, 31 bp, Artificial Sequence
  Primer
aaagaattcaatttactgagggcagatcgac

SEQ ID NO: 8454 - DNA, 31 bp, Artificial Sequence
  Primer
aaagaattcgattctgcacttctgtgtccag

SEQ ID NO: 8455 - DNA, 31 bp, Artificial Sequence
  Primer
aaaaggcctctaagtgaccaccgtacccttc

SEQ ID NO: 8456 - DNA, 31 bp, Artificial Sequence
  Primer
aaaggtaccaacatttcctggctcaatcatc

SEQ ID NO: 8457 - DNA, 36 bp, Artificial Sequence
  Primer
aaaaggcctctatataaagagctgaagacggacacg

SEQ ID NO: 8458 - DNA, 31 bp, Artificial Sequence
  Primer
aaagaattcaataatcgacgacgctaaccag

SEQ ID NO: 8459 - DNA, 39 bp, Artificial Sequence
  Primer
aaaaggccttaggattaattaacgcgatcatctctactt

SEQ ID NO: 8460 - DNA, 31 bp, Artificial Sequence
  Primer
aaagaattccactgagaagccatgtatctgc

SEQ ID NO: 8461 - DNA, 31 bp, Artificial Sequence
  Primer
aaagaattcatccaaggtttccactaagcag

SEQ ID NO: 8462 - DNA, 31 bp, Artificial Sequence
  Primer
aaagaattcaaacaaccaaatctatccgcac

SEQ ID NO: 8463 - DNA, 31 bp, Artificial Sequence
  Primer
aaagaattcagccagacatgatctcacaatg

SEQ ID NO: 8464 - DNA, 31 bp, Artificial Sequence
  Primer
aaagagctccaatccaagatcgataccaacc

SEQ ID NO: 8465 - DNA, 31 bp, Artificial Sequence
  Primer
aaagaattcgcaaagccagctatcagagaag

SEQ ID NO: 8466 - DNA, 31 bp, Artificial Sequence
  Primer
aaagaattcgcggcattgtttatttcagaac

SEQ ID NO: 8467 - DNA, 34 bp, Artificial Sequence
  Primer
aaagaattcctaaaatcggagatcatcaacgaac

SEQ ID NO: 8468 - DNA, 31 bp, Artificial Sequence
  Primer
aaagaattcgcatgaactaccaggaacaagg

SEQ ID NO: 8469 - DNA, 35 bp, Artificial Sequence
  Primer
aaagaattcctaggcaaacgaactttgaataatcc

SEQ ID NO: 8470 - DNA, 31 bp, Artificial Sequence
  Primer
aaagaattcccagtagtgacacagcaagagc

SEQ ID NO: 8471 - DNA, 31 bp, Artificial Sequence
  Primer
aaagaattccacgtcttcctccagtgattta

SEQ ID NO: 8472 - DNA, 30 bp, Artificial Sequence
  Primer
aaagaattccggcctgtacaatcaacaaac

SEQ ID NO: 8473 - DNA, 31 bp, Artificial Sequence
  Primer
aaagaattcctaaggctgaatcctcatcgac

SEQ ID NO: 8474 - DNA, 31 bp, Artificial Sequence
  Primer
aaaaggcctattcccacacatccaaactttc

SEQ ID NO: 8475 - DNA, 31 bp, Artificial Sequence
  Primer
aaaaggcctatcagttcgacaaacacgaatg

SEQ ID NO: 8476 - DNA, 34 bp, Artificial Sequence
  Primer
aaagaattcctactaggtgtgcaaagcatacagc

SEQ ID NO: 8477 - DNA, 31 bp, Artificial Sequence
  Primer
aaaggtacccatttggaacgagggaggtaac

SEQ ID NO: 8478 - DNA, 31 bp, Artificial Sequence
  Primer
aaagaattcgtatagaccacgggcatgaaac

SEQ ID NO: 8479 - DNA, 31 bp, Artificial Sequence
  Primer
aaagaattccaaactcaaacggtcctctttc

SEQ ID NO: 8480 - DNA, 31 bp, Artificial Sequence
  Primer
aaagaattccaaattgattgttcacgtctgc

SEQ ID NO: 8481 - DNA, 31 bp, Artificial Sequence
  Primer
aaagaattcattaagctaatgcggctgatcc

SEQ ID NO: 8482 - DNA, 31 bp, Artificial Sequence
  Primer
aaagaattcgtagcttcatcaatggcgtttc

SEQ ID NO: 8483 - DNA, 29 bp, Artificial Sequence
  Primer
aaagaattcgcaaacgagggcattgttac

SEQ ID NO: 8484 - DNA, 32 bp, Artificial Sequence
  Primer
aaagaattcttgcagctagttaagccactagg

SEQ ID NO: 8485 - DNA, 33 bp, Artificial Sequence
  Primer
aaagaattcctatgaagccagcgacttaacatc

SEQ ID NO: 8486 - DNA, 32 bp, Artificial Sequence
  Primer
aaagaattcgtttgaactttgaaggtgtgcag

SEQ ID NO: 8487 - DNA, 34 bp, Artificial Sequence
  Primer
aaagaattcggctttatatccctatccatcactc

SEQ ID NO: 8488 - DNA, 30 bp, Artificial Sequence
  Primer
aaaggtaccttgacaatcaagggaaggagg

SEQ ID NO: 8489 - DNA, 30 bp, Artificial Sequence
  Primer
aaaggtaccaaaggcgaaagactcagatcc

SEQ ID NO: 8490 - DNA, 31 bp, Artificial Sequence
  Primer
aaaaggcctggtaaattgatgggtcaacctg

SEQ ID NO: 8491 - DNA, 31 bp, Artificial Sequence
  Primer
aaaggtaccatgaagtcaccttccttccaac

SEQ ID NO: 8492 - DNA, 31 bp, Artificial Sequence
  Primer
aaagaattcaaatgacaaatcttggaggctg

SEQ ID NO: 8493 - DNA, 31 bp, Artificial Sequence
  Primer
aaagagctcgaaacaatgatcatgggactgg

SEQ ID NO: 8494 - DNA, 35 bp, Artificial Sequence
  Primer
aaaggtaccttgagtcacatatcagtgcaatacag

SEQ ID NO: 8495 - DNA, 31 bp, Artificial Sequence
  Primer
aaagaattctgacattgtggggattgataag

SEQ ID NO: 8496 - DNA, 31 bp, Artificial Sequence
  Primer
aaagaattcccaggccatatgagaaagaaac

SEQ ID NO: 8497 - DNA, 32 bp, Artificial Sequence
  Primer
aaaaggcctgtcacgtattcccttacgtgttg

SEQ ID NO: 8498 - DNA, 31 bp, Artificial Sequence
  Primer
aaaggtaccctctgacgacaaagacgaactg

SEQ ID NO: 8499 - DNA, 31 bp, Artificial Sequence
  Primer
aaagaattcattcagaacctctctcagccag

SEQ ID NO: 8500 - DNA, 31 bp, Artificial Sequence
  Primer
aaagaattcctcttctagggtttcctcctcc

SEQ ID NO: 8501 - DNA, 30 bp, Artificial Sequence
  Primer
aaaggatccgagctaagcccgagttactgc

SEQ ID NO: 8502 - DNA, 28 bp, Artificial Sequence
  Primer
aaaggatccgactctcgccaaacccaac

SEQ ID NO: 8503 - DNA, 31 bp, Artificial Sequence
  Primer
aaaggatcccatttctccaacccaatcactc

SEQ ID NO: 8504 - DNA, 30 bp, Artificial Sequence
  Primer
aaaggatcctaaacctcctccgctcttctc

SEQ ID NO: 8505 - DNA, 29 bp, Artificial Sequence
  Primer
aaaaggcctcgtcgaaccaaaccctatcc

SEQ ID NO: 8506 - DNA, 26 bp, Artificial Sequence
  Primer
aaaggatccgcggcagcatgagctct

SEQ ID NO: 8507 - DNA, 28 bp, Artificial Sequence
  Primer
aaagatatcgcggaaagagagaaagcgt

SEQ ID NO: 8508 - DNA, 29 bp, Artificial Sequence
  Primer
aaaggatccccacaatccctctaacgacc

SEQ ID NO: 8509 - DNA, 28 bp, Artificial Sequence
  Primer
aaagaattcactctccacagccatggac

SEQ ID NO: 8510 - DNA, 30 bp, Artificial Sequence
  Primer
aaaggatcccaactcgtgagccttcatcag

SEQ ID NO: 8511 - DNA, 30 bp, Artificial Sequence
  Primer
aaagaattcgatctgagttcaggcttgacg

SEQ ID NO: 8512 - DNA, 26 bp, Artificial Sequence
  Primer
aaaggatccagctgagtcgggatggg

SEQ ID NO: 8513 - DNA, 31 bp, Artificial Sequence
  Primer
aaacccgggctcacttcatccgtggaatctc

SEQ ID NO: 8514 - DNA, 30 bp, Artificial Sequence
  Primer
aaagaattcctccattcacgtgccctaatc

SEQ ID NO: 8515 - DNA, 29 bp, Artificial Sequence
  Primer
aaaggatccgagaagagctgtgggctgtg

SEQ ID NO: 8516 - DNA, 27 bp, Artificial Sequence
  Primer
aaaggatccacccaaacggagggacct

SEQ ID NO: 8517 - DNA, 28 bp, Artificial Sequence
  Primer
aaagatatctaagtgtgggagcgaatgg

SEQ ID NO: 8518 - DNA, 29 bp, Artificial Sequence
  Primer
aaaggatccaacaaccagcgtgctctctc

SEQ ID NO: 8519 - DNA, 28 bp, Artificial Sequence
  Primer
aaagaattccaaacaccacaaaggcgtg

SEQ ID NO: 8520 - DNA, 31 bp, Artificial Sequence
  Primer
aaacccgggtagattcacatcgcagcacaag

SEQ ID NO: 8521 - DNA, 31 bp, Artificial Sequence
  Primer
aaacccggggatgttggttagatttggcgtg

SEQ ID NO: 8522 - DNA, 27 bp, Artificial Sequence
  Primer
aaagaattcactgtcactcgcgatggc

SEQ ID NO: 8523 - DNA, 31 bp, Artificial Sequence
  Primer
aaaggatccttctagtcctacccaatccacc

SEQ ID NO: 8524 - DNA, 31 bp, Artificial Sequence
  Primer
aaacccgggatcctcatcttcttgatccgtg

SEQ ID NO: 8525 - DNA, 29 bp, Artificial Sequence
  Primer
aaaggatccgaatccctaccctgctcctc

SEQ ID NO: 8526 - DNA, 28 bp, Artificial Sequence
  Primer
aaagatatccgtcatcatggaggaggac

SEQ ID NO: 8527 - DNA, 31 bp, Artificial Sequence
  Primer
aaacccgggaggactgtgctgctgatttgtc

SEQ ID NO: 8528 - DNA, 31 bp, Artificial Sequence
  Primer
aaaggatccctagctaggatggaggaggagc

SEQ ID NO: 8529 - DNA, 27 bp, Artificial Sequence
  Primer
aaaggatcccaacaccacctgccattg

SEQ ID NO: 8530 - DNA, 27 bp, Artificial Sequence
  Primer
aaagaattcaggaatctatggcggcgt

SEQ ID NO: 8531 - DNA, 26 bp, Artificial Sequence
  Primer
aaaggatccgcgacatgccgtctctg

SEQ ID NO: 8532 - DNA, 31 bp, Artificial Sequence
  Primer
aaaggatcctctagtcaaggtccgtctctcc

SEQ ID NO: 8533 - DNA, 29 bp, Artificial Sequence
  Primer
aaacccgggctggaaattcacgcgctaag

SEQ ID NO: 8534 - DNA, 31 bp, Artificial Sequence
  Primer
aaaggatccgccactaggtctagggttcctc

SEQ ID NO: 8535 - DNA, 30 bp, Artificial Sequence
  Primer
aaaggatccaagctttctagcgattcctgg

SEQ ID NO: 8536 - DNA, 28 bp, Artificial Sequence
  Primer
aaaggatccgcgctccgcctatttaagg

SEQ ID NO: 8537 - DNA, 31 bp, Artificial Sequence
  Primer
aaaggatccatcaatcctagcatccttgctg

SEQ ID NO: 8538 - DNA, 31 bp, Artificial Sequence
  Primer
aaaggatcccctctgtcctgtcccactagac

SEQ ID NO: 8539 - DNA, 27 bp, Artificial Sequence
  Primer
aaaggatccacctcttgtccagtgccc

SEQ ID NO: 8540 - DNA, 27 bp, Artificial Sequence
  Primer
aaagaattcgaggccgagaggggaaat

SEQ ID NO: 8541 - DNA, 28 bp, Artificial Sequence
  Primer
aaaggatcctgagccgaacggaaagaac

SEQ ID NO: 8542 - DNA, 27 bp, Artificial Sequence
  Primer
aaaaggcctcaattcgagagcggttcc

SEQ ID NO: 8543 - DNA, 31 bp, Artificial Sequence
  Primer
aaaggatcccacaaagctcctctagcacctc

SEQ ID NO: 8544 - DNA, 28 bp, Artificial Sequence
  Primer
aaaggatcccgtagcgaaggatgtcgga

SEQ ID NO: 8545 - DNA, 26 bp, Artificial Sequence
  Primer
aaaggatccctccgtccgagtccgtt

SEQ ID NO: 8546 - DNA, 28 bp, Artificial Sequence
  Primer
aaagaattcgtcgaaaccacagccacac

SEQ ID NO: 8547 - DNA, 31 bp, Artificial Sequence
  Primer
aaagaattccgaatggtcgaacagtagtttg

SEQ ID NO: 8548 - DNA, 31 bp, Artificial Sequence
  Primer
aaaggatcccagcctcatcctatccaagaac

SEQ ID NO: 8549 - DNA, 28 bp, Artificial Sequence
  Primer
aaaggatcctgaaacagagccggtgaac

SEQ ID NO: 8550 - DNA, 31 bp, Artificial Sequence
  Primer
aaaggatccgatcagaccatttgtaccgacc

SEQ ID NO: 8551 - DNA, 35 bp, Artificial Sequence
  Primer
aaaggatccctgctatagatatgagatgcaagagg

SEQ ID NO: 8552 - DNA, 31 bp, Artificial Sequence
  Primer
aaaggatccctcgatatttagccgtggagag

SEQ ID NO: 8553 - DNA, 31 bp, Artificial Sequence
  Primer
aaaggatcctctgtaaaccacagtccacagc

SEQ ID NO: 8554 - DNA, 29 bp, Artificial Sequence
  Primer
aaaggatccaagaccaatcgaccatggct

SEQ ID NO: 8555 - DNA, 29 bp, Artificial Sequence
  Primer
aaagatatcgaggaggcgagatcttggag

SEQ ID NO: 8556 - DNA, 29 bp, Artificial Sequence
  Primer
aaaggatccgagtcctccacctccctctc

SEQ ID NO: 8557 - DNA, 28 bp, Artificial Sequence
  Primer
aaaaggcctcggtttctgcttgtccttg

SEQ ID NO: 8558 - DNA, 29 bp, Artificial Sequence
  Primer
aaagatatcctctcctcgcctagggtttc

SEQ ID NO: 8559 - DNA, 31 bp, Artificial Sequence
  Primer
aaaggatcctgagttgcacaggaaagtcttg

SEQ ID NO: 8560 - DNA, 30 bp, Artificial Sequence
  Primer
aaaggatccagcggagttcagtccagtctc

SEQ ID NO: 8561 - DNA, 28 bp, Artificial Sequence
  Primer
aaaggatccgctcactcacattggcacc

SEQ ID NO: 8562 - DNA, 30 bp, Artificial Sequence
  Primer
aaagaattcagtccaaggatccaatccaac

SEQ ID NO: 8563 - DNA, 28 bp, Artificial Sequence
  Primer
aaaggatccacatctcgatctcgccgtc

SEQ ID NO: 8564 - DNA, 31 bp, Artificial Sequence
  Primer
aaaggatccagtcttggattgctagctccag

SEQ ID NO: 8565 - DNA, 31 bp, Artificial Sequence
  Primer
aaaggatcctgagaaggatcgcctacaaatc

SEQ ID NO: 8566 - DNA, 29 bp, Artificial Sequence
  Primer
aaaggatccgcctaggaagtcagcacagc

SEQ ID NO: 8567 - DNA, 31 bp, Artificial Sequence
  Primer
aaaggatccgaaactagcgctgctaaacctc

SEQ ID NO: 8568 - DNA, 31 bp, Artificial Sequence
  Primer
aaaggatccgatcattgagcattcagcattg

SEQ ID NO: 8569 - DNA, 30 bp, Artificial Sequence
  Primer
aaaggatccaaaccaaagcaatcaaactgg

SEQ ID NO: 8570 - DNA, 31 bp, Artificial Sequence
  Primer
aaaggatcccccatcacaagttgattgtcag

SEQ ID NO: 8571 - DNA, 31 bp, Artificial Sequence
  Primer
aaacccggggtgttgatagtgaaaggcatcg

SEQ ID NO: 8572 - DNA, 31 bp, Artificial Sequence
  Primer
aaaggatcctttggtctacacacaccaccac

SEQ ID NO: 8573 - DNA, 31 bp, Artificial Sequence
  Primer
aaaaggcctagacataaggaagcgtctgcac

SEQ ID NO: 8574 - DNA, 30 bp, Artificial Sequence
  Primer
aaagaattccacagccaacaattaacctcg

SEQ ID NO: 8575 - DNA, 34 bp, Artificial Sequence
  Primer
aaagatatcggaattcaactattcaagcatggac

SEQ ID NO: 8576 - DNA, 31 bp, Artificial Sequence
  Primer
aaaaggcctcctgacaaactcctcgaatctg

SEQ ID NO: 8577 - DNA, 31 bp, Artificial Sequence
  Primer
aaaggtacctgcaagcaacaaggaaactagc

SEQ ID NO: 8578 - DNA, 31 bp, Artificial Sequence
  Primer
aaaaggcctagctttgcacctctcatctcac

SEQ ID NO: 8579 - DNA, 30 bp, Artificial Sequence
  Primer
aaagaattcttatccgcttaatgccgcttc

SEQ ID NO: 8580 - DNA, 31 bp, Artificial Sequence
  Primer
aaagaattccaacctaaacatcgaaacctcg

SEQ ID NO: 8581 - DNA, 31 bp, Artificial Sequence
  Primer
aaaaggccttcaagcttcctcagaattcacc

SEQ ID NO: 8582 - DNA, 31 bp, Artificial Sequence
  Primer
aaagaattcgattgttcatgatgaccctgtg

SEQ ID NO: 8583 - DNA, 34 bp, Artificial Sequence
  Primer
aaagaattcctaagatttgcaagaacatgactgc

SEQ ID NO: 8584 - DNA, 34 bp, Artificial Sequence
  Primer
aaagaattcctactccctaagcaacgagagaacc

SEQ ID NO: 8585 - DNA, 32 bp, Artificial Sequence
  Primer
aaaaggcctctgcagaccaactctctatcagg

SEQ ID NO: 8586 - DNA, 32 bp, Artificial Sequence
  Primer
aaaggtacccaaccaacaatacagttcagacg

SEQ ID NO: 8587 - DNA, 35 bp, Artificial Sequence
  Primer
aaaaggcctttcaactcacagattattatcccacc

SEQ ID NO: 8588 - DNA, 32 bp, Artificial Sequence
  Primer
aaagaattcgcaaagttaactctcgctgtgac

SEQ ID NO: 8589 - DNA, 31 bp, Artificial Sequence
  Primer
aaagaattcatctccaggtgtcacggtctac

SEQ ID NO: 8590 - DNA, 31 bp, Artificial Sequence
  Primer
aaaaggcctgtgatgatgcgtccaaatactg

SEQ ID NO: 8591 - DNA, 31 bp, Artificial Sequence
  Primer
aaaggtaccttcagatgtcttgctctgttcg

SEQ ID NO: 8592 - DNA, 33 bp, Artificial Sequence
  Primer
aaagaattctgtcatcagcatcactacacacac

SEQ ID NO: 8593 - DNA, 33 bp, Artificial Sequence
  Primer
aaaggtaccttaatcaaccaaccaattcaatca

SEQ ID NO: 8594 - DNA, 31 bp, Artificial Sequence
  Primer
aaagaattcgattctgacttcatctccgctc

SEQ ID NO: 8595 - DNA, 33 bp, Artificial Sequence
  Primer
aaaaggcctctatacatgaacaaagccaccacc

SEQ ID NO: 8596 - DNA, 31 bp, Artificial Sequence
  Primer
aaaggtacccagcttggcgtactatcctctc

SEQ ID NO: 8597 - DNA, 31 bp, Artificial Sequence
  Primer
aaacccgggtgacgcttagttgtccattcag

SEQ ID NO: 8598 - DNA, 31 bp, Artificial Sequence
  Primer
aaaaggcctgcaatttgtagtgccaaacctc

SEQ ID NO: 8599 - DNA, 35 bp, Artificial Sequence
  Primer
aaagaattcctagtagaccaaacgagcaagttcac

SEQ ID NO: 8600 - DNA, 32 bp, Artificial Sequence
  Primer
aaagaattcctacagatgcccaatttgatgtg

SEQ ID NO: 8601 - DNA, 30 bp, Artificial Sequence
  Primer
aaacccgggttattacgcacacggcatctc

SEQ ID NO: 8602 - DNA, 34 bp, Artificial Sequence
  Primer
aaagaattcctataaacctgacagcgacagatcc

SEQ ID NO: 8603 - DNA, 35 bp, Artificial Sequence
  Primer
aaagaattcctacataaccaagaaacgaaccagag

SEQ ID NO: 8604 - DNA, 31 bp, Artificial Sequence
  Primer
aaaggtacctgaggctgaagaacatctcatc

SEQ ID NO: 8605 - DNA, 31 bp, Artificial Sequence
  Primer
aaagatatcccagcatcactatcaacagcag

SEQ ID NO: 8606 - DNA, 33 bp, Artificial Sequence
  Primer
aaagaattctcaatgcagaaagagagtacatgg

SEQ ID NO: 8607 - DNA, 34 bp, Artificial Sequence
  Primer
aaaaggcctctatgtgtagttagcagctcgttgg

SEQ ID NO: 8608 - DNA, 31 bp, Artificial Sequence
  Primer
aaagaattcagctcttcaccaacacttccag

SEQ ID NO: 8609 - DNA, 31 bp, Artificial Sequence
  Primer
aaagaattcagctgtctttcaggacaccaac

SEQ ID NO: 8610 - DNA, 31 bp, Artificial Sequence
  Primer
aaagaattctatggtcatgaaggcgaagaag

SEQ ID NO: 8611 - DNA, 31 bp, Artificial Sequence
  Primer
aaagaattctcggccgaaagaataagagaag

SEQ ID NO: 8612 - DNA, 31 bp, Artificial Sequence
  Primer
aaaggtaccagaacagagacgggcatgatac

SEQ ID NO: 8613 - DNA, 31 bp, Artificial Sequence
  Primer
aaagaattcaacaggcgctatgtaacacaag

SEQ ID NO: 8614 - DNA, 31 bp, Artificial Sequence
  Primer
aaagaattcctcctatcctgctctggttcag

SEQ ID NO: 8615 - DNA, 31 bp, Artificial Sequence
  Primer
aaagaattcccatcacagtcacactacggac

SEQ ID NO: 8616 - DNA, 31 bp, Artificial Sequence
  Primer
aaagaattcatgggaagtggaatacatcgtc

SEQ ID NO: 8617 - DNA, 31 bp, Artificial Sequence
  Primer
aaagaattccactacgagctagttgagctgc

SEQ ID NO: 8618 - DNA, 36 bp, Artificial Sequence
  Primer
aaagagctcctagtacagcccttgtttgtaattcct

SEQ ID NO: 8619 - DNA, 29 bp, Artificial Sequence
  Primer
aaagaattctggttctggctttctggaac

SEQ ID NO: 8620 - DNA, 31 bp, Artificial Sequence
  Primer
aaagagctcgttctaccttgcgaatcacctc

SEQ ID NO: 8621 - DNA, 36 bp, Artificial Sequence
  Primer
aaaggtaccctaaaacataatcaacagaagcgatgc

SEQ ID NO: 8622 - DNA, 34 bp, Artificial Sequence
  Primer
aaagaattcctatgctgatgatcggtgatgatac

SEQ ID NO: 8623 - DNA, 31 bp, Artificial Sequence
  Primer
aaagaattcatactgaagctcccatttgcag

SEQ ID NO: 8624 - DNA, 34 bp, Artificial Sequence
  Primer
aaaaggcctctatttcacatgacagcaacaagtg

SEQ ID NO: 8625 - DNA, 33 bp, Artificial Sequence
  Primer
aaaaggcctagtagacaatgcacctcactcaat

SEQ ID NO: 8626 - DNA, 31 bp, Artificial Sequence
  Primer
aaagaattccatggacacaagaagagctcag

SEQ ID NO: 8627 - DNA, 34 bp, Artificial Sequence
  Primer
aaagaattcctactatggagagcaacattccgag

SEQ ID NO: 8628 - DNA, 32 bp, Artificial Sequence
  Primer
aaagaattctgctaacccgtcactaatctctg

SEQ ID NO: 8629 - DNA, 33 bp, Artificial Sequence
  Primer
aaagaattcctaatggaccgttcgcttattcag

SEQ ID NO: 8630 - DNA, 31 bp, Artificial Sequence
  Primer
aaagaattcgacgtacaattgtgttgccatc

SEQ ID NO: 8631 - DNA, 30 bp, Artificial Sequence
  Primer
aaagaattcctaaccaggtccgtccaactc

SEQ ID NO: 8632 - DNA, 31 bp, Artificial Sequence
  Primer
aaagaattctcagaaaccacggataaaccac

SEQ ID NO: 8633 - DNA, 31 bp, Artificial Sequence
  Primer
aaagaattctagataccagaaccgaccaacc

SEQ ID NO: 8634 - DNA, 31 bp, Artificial Sequence
  Primer
aaagaattcgacatgatctcacaatgccaac

SEQ ID NO: 8635 - DNA, 31 bp, Artificial Sequence
  Primer
aaagagctcaactaacctaacgcaccagcac

SEQ ID NO: 8636 - DNA, 31 bp, Artificial Sequence
  Primer
aaagaattcatctccagtctttcagtccacg

SEQ ID NO: 8637 - DNA, 31 bp, Artificial Sequence
  Primer
aaagaattcaggtgaccacaagctacaaagg

SEQ ID NO: 8638 - DNA, 31 bp, Artificial Sequence
  Primer
aaagaattccatcgacgacgatatgtacagg

SEQ ID NO: 8639 - DNA, 32 bp, Artificial Sequence
  Primer
aaaaggcctccacacatccaaactttctgttc

SEQ ID NO: 8640 - DNA, 31 bp, Artificial Sequence
  Primer
aaaaggcctttcggctagcagtgtgatagtg

SEQ ID NO: 8641 - DNA, 34 bp, Artificial Sequence
  Primer
aaaggtaccttaactctcttcttaatgaggcacg

SEQ ID NO: 8642 - DNA, 31 bp, Artificial Sequence
  Primer
aaagaattctgctaccatcttctaggcaagg

SEQ ID NO: 8643 - DNA, 31 bp, Artificial Sequence
  Primer
aaagaattcaaacaatgaagcctagacgtgg

SEQ ID NO: 8644 - DNA, 32 bp, Artificial Sequence
  Primer
aaagaattcgcactgcatcctggagttagtag

SEQ ID NO: 8645 - DNA, 31 bp, Artificial Sequence
  Primer
aaagaattcacgtgctaacagggtcatatcc

SEQ ID NO: 8646 - DNA, 32 bp, Artificial Sequence
  Primer
aaagaattcgccaacacattgattatgtctcc

SEQ ID NO: 8647 - DNA, 31 bp, Artificial Sequence
  Primer
aaaggtaccgcgaaagactcagatccatagc

SEQ ID NO: 8648 - DNA, 31 bp, Artificial Sequence
  Primer
aaaaggcctgggtcaacctgtttatctcacc

SEQ ID NO: 8649 - DNA, 32 bp, Artificial Sequence
  Primer
aaaggtacctccaactatagctccttacgtgg

SEQ ID NO: 8650 - DNA, 34 bp, Artificial Sequence
  Primer
aaagaattcctagcacctgttcatcattgatctg

SEQ ID NO: 8651 - DNA, 31 bp, Artificial Sequence
  Primer
aaagagctctgtaaggaaatcacaaggctgc

SEQ ID NO: 8652 - DNA, 31 bp, Artificial Sequence
  Primer
aaaaggccttgctatctcatctggtcactgg

SEQ ID NO: 8653 - DNA, 31 bp, Artificial Sequence
  Primer
aaaggtaccatgtgggatatttcgtcgagtc
